(12) United States Patent
Molinero

(10) Patent No.: US 8,569,575 B2
(45) Date of Patent: Oct. 29, 2013

(54) PLANTS HAVING ENHANCED YIELD-RELATED TRAITS AND A METHOD FOR MAKING THE SAME

(75) Inventor: Ana Isabel Sanz Molinero, Gentbrugge (BE)

(73) Assignee: BASF Plant Science GmbH (DE)

( * ) Notice: Subject to any disclaimer, the term of this patent is extended or adjusted under 35 U.S.C. 154(b) by 627 days.

(21) Appl. No.: 12/519,787

(22) PCT Filed: Dec. 21, 2007

(86) PCT No.: PCT/EP2007/064510
§ 371 (c)(1),
(2), (4) Date: Jul. 15, 2009

(87) PCT Pub. No.: WO2008/074891
PCT Pub. Date: Jun. 26, 2008

(65) Prior Publication Data
US 2010/0077502 A1 Mar. 25, 2010

Related U.S. Application Data

(60) Provisional application No. 60/883,353, filed on Jan. 4, 2007, provisional application No. 60/883,355, filed on Jan. 4, 2007, provisional application No. 60/886,106, filed on Jan. 23, 2007, provisional application No. 60/886,105, filed on Jan. 23, 2007, provisional application No. 60/886,104, filed on Jan. 23, 2007.

(30) Foreign Application Priority Data

| Dec. 21, 2006 | (EP) | 06126852 |
| Dec. 21, 2006 | (EP) | 06126891 |
| Dec. 21, 2006 | (EP) | 06126950 |
| Dec. 22, 2006 | (EP) | 06127101 |
| Dec. 22, 2006 | (EP) | 06127112 |

(51) Int. Cl.
*A01H 1/00* (2006.01)

(52) U.S. Cl.
USPC .......................................... 800/278; 800/287

(58) Field of Classification Search
None
See application file for complete search history.

(56) References Cited

U.S. PATENT DOCUMENTS

| 6,310,271 | B1 * | 10/2001 | Hanson et al. | 800/278 |
| 6,512,167 | B1 * | 1/2003 | Carolo | 800/320.1 |
| 7,135,616 | B2 * | 11/2006 | Heard et al. | 800/278 |
| 7,235,710 | B2 * | 6/2007 | Hatzfeld et al. | 800/278 |
| 2004/0034888 | A1 | 2/2004 | Liu et al. | |
| 2006/0015970 | A1 | 1/2006 | Pennell et al. | |

FOREIGN PATENT DOCUMENTS

| EP | 1033405 A2 | 9/2000 |
| JP | 2004-283078 A | 10/2004 |
| WO | WO-02/16655 A2 | 2/2002 |
| WO | WO-2006/067232 A2 | 6/2006 |

OTHER PUBLICATIONS

Green et al (2002, Plant Physiology 129:576-584).*
Wang et al., (1998, Cell, 93:1207-1217).*
Wang et al (1998, Cell 93:1207-1217).*
Bowie et al, Science 247:1306-1310, 1990.*
McConnell et al, Nature 411 (6838):709-713, 2001.*
Kuroyanagi, M., et al., "Vacuolar Processing Enzyme is Essential for Mycotoxin-induced Cell Death in *Arabidopsis thaliana*", The Journal of Biological Chemistry, vol. 280, No. 38, (2005), pp. 32914-32920.
Kinoshita, T., et al., "The Sequence and Expression of the γ-VPE Gene, One Member of a Family of Three Genes for Vacuolar Processing Enzymes in *Arabidopsis thaliana*", Plant Cell Physiol., vol. 36, No. 8, (1995), pp. 1555-1562.

* cited by examiner

*Primary Examiner* — Stuart F Baum
(74) *Attorney, Agent, or Firm* — Novak Druce Connolly Bove + Quigg LLP

(57) ABSTRACT

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding a Yield Enhancing Protein (YEP). The YEP is selected from a Vacuolar Processing Enzyme (VPE) or a CCA1-like polypeptide or a SAP-like polypeptide or a Seed Yield Promoting Factor 1 (SYPF1) polypeptide or a Ribulose-1,5-bisphosphate carboxylase/oxygenase (RuBisCO) activase (RCA) polypeptide. The present invention also concerns plants having modulated expression of a nucleic acid encoding such a YEP, which plants have enhanced yield-related traits relative to control plants. The invention also provides hitherto unknown YEP-encoding nucleic acids, and constructs comprising the same, useful in performing the methods of the invention.

13 Claims, 160 Drawing Sheets

METNSSGEDLVIKTRKPYTITKQRERWTEEEHNRFIEALRLYGRAWQKIEEHVATK
TAVQIRSHAQKFFSKVEKEAEAKGVAMGQALDIAI*PPPRPK*RKPNNPYPRKTGSGT
ILMSKTGVNDGKESLGSEKVSHPEMANEDRQQSKPEEKTLQEDNCSDCFTHQYLSA
ASSMNKSCIETSNASTFREFLPSREEGSQNNRVRKESNSDLNAKSLENGNEQGPQT
YPMHIPVLVPLGSSITSSLSHPPSEPDSHPHTVAGDYQSFPNHIMSTLLQTPALYT
AATFASSFWPPDSSGGSPVPGNSPPNLAAMAA*ATVAAASAWWA*ANGLLPLCAPLSS
GGFTSHPPSTFGPSCDVEYTKASTLQHGSVQSREQEHSEASKARSSLDSEDVENKS
KPVCHEQPSATPESDAKGSDGAGDRKQV*DRSSCGSNT*PSSSDDVEADASERQEDGT
NGEVKETNEDTNKPQTSESNARRSRISSNITDPWKSVSDEGRIAFQALFSREVLPQ
SFTYREEHREEEQQQQEQRYPMALDLNFTAQLTPVDDQEEKRNTGFLGIGLDASKL
MSRGRTGFKPYKRCSMEAKESRILNNNPIIHVEQKDPKRMRLETQAST

Figure 1

```
SEQ ID NO: 6      ------------------------------------------------------------
SEQ ID NO: 14     ------------------------------------------------------------
SEQ ID NO: 138    -------------------------------ALEKGEKGKEEPETPDANQLAIDFSNR
SEQ ID NO: 128    ------------------------------------------------------------
SEQ ID NO: 130    ------------------------------------------------------------
SEQ ID NO: 124    ------------------------------------------------------------
SEQ ID NO: 8      ------------------------------------------------------------
SEQ ID NO: 10     ------------------------------------------------------------
SEQ ID NO: 12     ------------------------------------------------------------
SEQ ID NO: 134    ------------------------------------------------------------
SEQ ID NO: 136    ------------------------------------------------------------
SEQ ID NO: 66     ------------------------------------------------------------
SEQ ID NO: 126    ------------------------------------------------------------
SEQ ID NO: 42     ------------------------------------------------------------
SEQ ID NO: 52     ------------------------------------------------------------
SEQ ID NO: 96     ------------------------------------------------------------
SEQ ID NO: 122    ------------------------------------------------------------
SEQ ID NO: 84     ------------------------------------------------------------
SEQ ID NO: 86     ------------------------------------------------------------
SEQ ID NO: 90     ------------------------------------------------------------
SEQ ID NO: 98     ------------------------------------------------------------
SEQ ID NO: 92     ------------------------------------------------------------
SEQ ID NO: 88     ------------------------------------------------------------
SEQ ID NO: 94     ------------------------------------------------------------
SEQ ID NO: 4      ------------------------------------------------------------
SEQ ID NO: 100    ------------------------------------------------------------
SEQ ID NO: 104    ------------------------------------------------------------
SEQ ID NO: 2      ------------------------------------------------------------
SEQ ID NO: 72     ------------------------------------------------------------
SEQ ID NO: 102    ------------------------------------------------------------
SEQ ID NO: 16     ------------------------------------------------------------
SEQ ID NO: 24     ------------------------------------------------------------
SEQ ID NO: 78     ------------------------------------------------------------
SEQ ID NO: 108    ------------------------------------------------------------
SEQ ID NO: 80     ------------------------------------------------------------
SEQ ID NO: 34     ------------------------------------------------------------
SEQ ID NO: 112    ------------------------------------------------------------
SEQ ID NO: 114    ------------------------------------------------------------
SEQ ID NO: 116    ------------------------------------------------------------
SEQ ID NO: 82     ------------------------------------------------------------
SEQ ID NO: 110    ------------------------------------------------------------
SEQ ID NO: 118    ------------------------------------------------------------
SEQ ID NO: 106    ------------------------------------------------------------
SEQ ID NO: 132    ------------------------------------------------------------
SEQ ID NO: 120    ------------------------------------------------------------
SEQ ID NO: 18     ------------------MAAVS----------SSSE--TGDCGVTGKRDE--------
SEQ ID NO: 22     ------------------MADGS----------TSSSESTTACAGSGTRRE--------
SEQ ID NO: 30     ------------------MT----------------RRCSHCSNNGHNSR-----TCP
SEQ ID NO: 44     ------------------MT----------------RRCSHCSNNGHNAR-----TCP
SEQ ID NO: 36     ------------------MT----------------RRCSHCNHNGHNSR-----TCP
SEQ ID NO: 74     ------------------MT----------------RRCSHCSHNGHNSR-----TCP
SEQ ID NO: 20     ------------------MS----------------RSCSQCGNNGHNSR-----TCP
SEQ ID NO: 68     ------------------MTRDGALPASGGGGAAEGPRRCSQCGHHGHNAR-----TCT
SEQ ID NO: 46     ------------------MA----------------RKCSSCGNNGHNSR-----TCT
SEQ ID NO: 54     ------------------MA----------------RKCSSCGNNGHNSR-----TCS
SEQ ID NO: 48     ------------------MA----------------RKCSYCGNYGHNSRTCSSSASA
SEQ ID NO: 56     --------------MHAIMA----------------RRCS--GDY----------STA
SEQ ID NO: 38     ------------------MG----------------RRCSHCGNVGHNSR-----TCS
SEQ ID NO: 40     ------------------MVKET----------VTVAKTCSHCGHNGHNAR-----TCL
SEQ ID NO: 70     ------------------MP----------------QDSRPAAMRLFGV--------
SEQ ID NO: 76     ------------------ME----------------QHEEAAERKPSPP--------
SEQ ID NO: 26     --------------------------------MDAAIPIWKRDDDKR--------
SEQ ID NO: 32     --------------------------------MAAFPQWTRVDDKR--------
SEQ ID NO: 28     --------------------------------MASSPRWTEDDNRR--------
SEQ ID NO: 62     -----------------------MEWTAAELAEARSVIARVSDAYNSGVGSSS
SEQ ID NO: 64     MLLSHCFAVAFALSALLAGLALAMDDATFGMEWTAAELGEARSVIARVSNAYDSGAGSSN
SEQ ID NO: 60     ----------------------------MEWTAAEMDEARSIIARLTNAYDSGTLVAG
SEQ ID NO: 58     ----------------------MGSIVIEGWTASEIEEARSLITSPNNGGEGGDGEGN
SEQ ID NO: 50     -----------------MPTDDATATGNGDGAAPRPAAAEPAAPLSSVWTRRDEKLLE
```

FIGURE 2 B

```
SEQ ID NO: 6     ----------------------------------------------------------
SEQ ID NO: 14    ----------------------------------------------------------
SEQ ID NO: 138   RRSVSNLTDSWKEVSEEGRLAFQALFSREVLPQSFSPPHALKNKNQQMDNANNNKQNIEN
SEQ ID NO: 128   ----------------------------------------------------------
SEQ ID NO: 130   ----------------------------------------------------------
SEQ ID NO: 124   ----------------------------------------------------------
SEQ ID NO: 8     ----------------------------------------------------------
SEQ ID NO: 10    ----------------------------------------------------------
SEQ ID NO: 12    ----------------------------------------------------------
SEQ ID NO: 134   ----------------------------------------------------------
SEQ ID NO: 136   ----------------------------------------------------------
SEQ ID NO: 66    ----------------------------------------------------------
SEQ ID NO: 126   ----------------------------------------------------------
SEQ ID NO: 42    ----------------------------------------------------------
SEQ ID NO: 52    ----------------------------------------------------------
SEQ ID NO: 96    ----------------------------------------------------------
SEQ ID NO: 122   ----------------------------------------------------------
SEQ ID NO: 84    ----------------------------------------------------------
SEQ ID NO: 86    ----------------------------------------------------------
SEQ ID NO: 90    ----------------------------------------------------------
SEQ ID NO: 98    ----------------------------------------------------------
SEQ ID NO: 92    ----------------------------------------------------------
SEQ ID NO: 88    ----------------------------------------------------------
SEQ ID NO: 94    ----------------------------------------------------------
SEQ ID NO: 4     ----------------------------------------------------------
SEQ ID NO: 100   ----------------------------------------------------------
SEQ ID NO: 104   ----------------------------------------------------------
SEQ ID NO: 2     ----------------------------------------------------------
SEQ ID NO: 72    ----------------------------------------------------------
SEQ ID NO: 102   ----------------------------------------------------------
SEQ ID NO: 16    ----------------------------------------------------------
SEQ ID NO: 24    ----------------------------------------------------------
SEQ ID NO: 78    ----------------------------------------------------------
SEQ ID NO: 108   ----------------------------------------------------------
SEQ ID NO: 80    ----------------------------------------------------------
SEQ ID NO: 34    ----------------------------------------------------------
SEQ ID NO: 112   ---------------------------------------------------------M
SEQ ID NO: 114   ---------------------------------------------------------M
SEQ ID NO: 116   ----------------------------------------------------------
SEQ ID NO: 82    ---------------------------------------------------------M
SEQ ID NO: 110   ----------------------------------------------------------
SEQ ID NO: 118   ----------------------------------------------------------
SEQ ID NO: 106   ----------------------------------------------------------
SEQ ID NO: 132   ----------------------------------------------------------
SEQ ID NO: 120   ----------------------------------------------------------
SEQ ID NO: 18    ------------------------IMLFGVRVVVDP----------------------
SEQ ID NO: 22    ------------------------IMLFGVRVVLDP----------------------
SEQ ID NO: 30    TRGGGTCGGSGGGGGGGGGGGGSGSSSAMKLFGVRLTDGS------------------
SEQ ID NO: 44    ARGG------GGGGGG----------VRLFGVRLTSPPEV------------------
SEQ ID NO: 36    NRG-----------------------VKLFGVRLTEGS--------------------
SEQ ID NO: 74    NRG-----------------------VKIFGVRLTDGS--------------------
SEQ ID NO: 20    TDITTTGDNNDKGGGE---------KAIMLFGVRVTEASSS-----------------
SEQ ID NO: 68    ARGP----------------------VKLFGVRIGDKP--------------------
SEQ ID NO: 46    GQRSLQESGGGYGGG--------GAGGVRLFGVQLHVGG-------------------
SEQ ID NO: 54    GQRVLDHSTSSSNSGSTTAAAATACGGLRLFGVQLQVGGGS-----------------
SEQ ID NO: 48    GERDTTMLCDGGDGG--------GGSGLRLFGVQVHVAAGGGGG-----------GGG
SEQ ID NO: 56    GQRAG----EEGGGG--------GGAGLRLFGVQLHAAAASSPA-----------S--
SEQ ID NO: 38    SYQTR---------------------VVRLFGVIILDTTSSS----------------
SEQ ID NO: 40    NGVN------------------KASVKLFGVNISSDP---------------------
SEQ ID NO: 70    ------------------------TISPPPPPEPEPEPDPS-----------------
SEQ ID NO: 76    ------------------------VIFRLFGVEVRGGGGVD-----------------
SEQ ID NO: 26    ------------------------FELALVRFPAEGSPDF-----------------
SEQ ID NO: 32    ------------------------FELALLQIP-EGSPNF-----------------
SEQ ID NO: 28    ------------------------FKSALSQFPPDNKR-------------------
SEQ ID NO: 62    S-ACDTKHDRIMRELQARFFSRTMVQVIDLYVNLTVETAAQ-----PQDAG-------
SEQ ID NO: 64    S-AGDTKHDRIMRELQARFFSRTMVQVIDLYLNLTAETAAQAGAAQPQDAG-------
SEQ ID NO: 60    AGNGDTRHDRIVRELQAWLFWRTMDQLIGLYIELMAEEPAAA---QPQYF--------
SEQ ID NO: 58    K---QKHCGHIVMELHEWFFWKTIGQVIGLYMKLNAGKPMVMHSLNKSDANNSIGEVDHV
SEQ ID NO: 50    MLLWRWQLDPHWDRLAAELGGKTATQVFDRYVCLADELRLVMAAPAVDTPP-------A
```

FIGURE 2 B (continued)

```
SEQ ID NO: 6      ------------------------------MTST--------------------NPVVA
SEQ ID NO: 14     ------------------------------MSSSPS------------------RNPTNA
SEQ ID NO: 138    NEGLLTIGLGQGKLKTRRTGFKPYKRCSMEAKENRVGASNNQGEEQGCKRIRXEGETSTS
SEQ ID NO: 128    --------------------------------------------------------SLP
SEQ ID NO: 130    -----------------------------------------------------NLDPSGMSLP
SEQ ID NO: 124    --------------------------MVSKNPNPPEGL---------YLDPNESGMPLP
SEQ ID NO: 8      ------------------------------MVSRNSDG------------YFLDPTGMTVP
SEQ ID NO: 10     ------------------------------MVTVNPSQAHC---------LPMKMSLPGFNT
SEQ ID NO: 12     ------------------------------MVSVNP-RPKG---------FPVFDSSNMSLP
SEQ ID NO: 134    ------------------------------MVSVNPSPAQG---------FYFFDPSNMVLP
SEQ ID NO: 136    ------------------------------MVSVNPNPAQG---------FYFFDPSNMTLP
SEQ ID NO: 66     ------------------------------------------------------------
SEQ ID NO: 126    -----------------------------------------------------------MVST
SEQ ID NO: 42     ------------------------------------------------------------MDR
SEQ ID NO: 52     ------------------------------------------------------------
SEQ ID NO: 96     ------------------------------------------------------------
SEQ ID NO: 122    ------------------------------------------------------------
SEQ ID NO: 84     ------------------------------------------------------------
SEQ ID NO: 86     ------------------------------------------------------------
SEQ ID NO: 90     ------------------------------------------------------------
SEQ ID NO: 98     ------------------------------------------------------------
SEQ ID NO: 92     ------------------------------------------------------------
SEQ ID NO: 88     ------------------------------------------------------------
SEQ ID NO: 94     ------------------------------------------------------------
SEQ ID NO: 4      ------------------------------------------------------------
SEQ ID NO: 100    ------------------------------------------------------------
SEQ ID NO: 104    ------------------------------------------------------------
SEQ ID NO: 2      ------------------------------------------------------------
SEQ ID NO: 72     ------------------------------------------------------------
SEQ ID NO: 102    ------------------------------------------------------------
SEQ ID NO: 16     ---------------------------------MAAEDRSEELSSNVENGSCN
SEQ ID NO: 24     -----------------------MVMMIIYTEPEISLFPLQDRSEELSSNVENGSCN
SEQ ID NO: 78     -----------------------MEMACLPGNAMATDENGADDRAGGESTVDHLRSHM
SEQ ID NO: 108    -------------------------MACTQENAMATD---------ESTADHRGSRP
SEQ ID NO: 80     -----------------------MARFQETKARNDQGPVADHVGHQNLMENLTDPL
SEQ ID NO: 34     ---------------------------------------------MAMQERCESL
SEQ ID NO: 112    EMQ--------------------------------------DQIESTRSTIFGSASNI
SEQ ID NO: 114    EMQVSIILRSLFWRLFSSFNRKKENFNMNSSSDFISKELKYILDQIESTRSTIFGSASNI
SEQ ID NO: 116    ---------------------------------MVKSNPKMLL-----I
SEQ ID NO: 82     ASMPQLE-------------------EKDSSDLAINKGPSLDLVKSPLMMNDASATVT
SEQ ID NO: 110    -------------------------MAIQDQNGFFRSQGGPPEGGGVSLSS-GHSVTHI
SEQ ID NO: 118    ------------------------------------------------------------
SEQ ID NO: 106    -------------------------MAIQGQNAFTRSQGGLPIGDEISFNSGVHSVADI
SEQ ID NO: 132    ------------------------------------------------------------
SEQ ID NO: 120    ------------------------------------------GEAPSSNDTGDEATVT
SEQ ID NO: 18     ----MRKCVSLNNLSDYEKSSPEDEIPKIVTAGAGDGEDK---------------NETDA
SEQ ID NO: 22     ----MRKCVSLNNLSDYEQTA---ETPKI------DGEDR---------------DEQDM
SEQ ID NO: 30     ---IIKKSASMGNLSALAVAAAAATHHRLSPSSPLATSNL--------NDSPLSDHARYS
SEQ ID NO: 44     ---AMKKSASMS-----CIASSLGSGGGSGGSSPAGTG-----------------RGGGG
SEQ ID NO: 36     -----IRKSASMGN---LSHYTGSGSGGHGTGSNTPGSP-----------------GDVP
SEQ ID NO: 74     -----IRKSASMGN---LSLLS-SAAGSTSGGASPADGP-----------------DAAP
SEQ ID NO: 20     ---CFRKSVSMNN---------LSQFDQTPDPNPTDDG---------------------
SEQ ID NO: 68     ------PTAAAGGGGMRKSASMGSLAQLAEGGGGGGG----------------------
SEQ ID NO: 46     --APLKKCFSMECLSSPSPSPSPAYYAAVAAAASNSSPTVS-------SSSSLVSVEEAG
SEQ ID NO: 54     --SPLKKCLSMECLASP------AYYGASASPSVSSS------------SSSLVSIEENT
SEQ ID NO: 48     GGLPMKKSYSMDCLQLAAAG----AAPGSLVSPSSSSS-----------SSMLLSIDEGG
SEQ ID NO: 56     ---YLHKSYSMDCLRLQVS-----SPSSLQSSSSSPSPL---------TSSLLLSIDEGC
SEQ ID NO: 38     --PPPPPPPSILAAAIKKS----FSMDCLPACSSSSS----------------------
SEQ ID NO: 40     -----IRPPEVTALRKSLSLGNLDALLANDESNGSGDP--------------------I
SEQ ID NO: 70     --DPRDPSPRPAREDAMRKCKSMGNLAAAAAASSAAAGGG----------------GAGD
SEQ ID NO: 76     --EEEYEEEEVEGGLFIKKSSSMPNLTSIDPLPVPADG-------------------GK
SEQ ID NO: 26     ---LENIAQFLQKPLKEVYSYYQALVDDVTL--------------------------IES
SEQ ID NO: 32     ---IENIAYYLQKPVKEVEYYYCALVHDIER--------------------------IES
SEQ ID NO: 28     ---LVNVAQHLPKPLEEVKYYYEKLVNDVYLPKPLENVTQ---------HLQKPMEMEE
SEQ ID NO: 62     --SAGDAAAVVHPTFAG--------GMP---VVNNND----------------------
SEQ ID NO: 64     --GAGD-AAVVHPTFGLANDN---FGMP---VANNNDD----------------GVDA
SEQ ID NO: 60     -----DAGAVVDPTFDFFNDHNNFLGMPPPPVQQADDHNMNNVVADAGMNYYYGGGGAGG
SEQ ID NO: 58     SALANGNPVRLEEHRPMLNNVGLVFDYPLEEMEMENQTD---------------QEP
SEQ ID NO: 50     WDVQDEREAAVAPLPGLEADAAAGAGESAEVTAIGIAAA------------------ASP
```

FIGURE 2 B (continued)

```
SEQ ID NO: 6      EVIP-AETSTDATETTIA--------------TTEAGEAPEKKVRKAYTITKSRESWTEGE
SEQ ID NO: 14     EAPPPPPTSTDA----------------------VAEGSSKKVRKPYTITKSRESWTEEE
SEQ ID NO: 138    EQIDMNSTTNTSNSQSMA-------------AAAAFSDGSGKKVRKPYTITKSRESWTEEE
SEQ ID NO: 128    GILP-FAAAATAT------------------ADSFEDPAKKTRKPYTITKSRESWTEPE
SEQ ID NO: 130    GILP-FAAAATAT------------------ADSFEDPAKKTRKPYTITKSRESWTEPE
SEQ ID NO: 124    GLGP-FASATATTST----------------TSSSAEDLSKKIRKPYTITKSRESWSEEE
SEQ ID NO: 8      GLGPSFTAAVSSSSSPTTSSTAVAVADVTAMVSSSEEDLSKKIRKPYTITKSRESWTEPE
SEQ ID NO: 10     LPHTATTIPVSIRSNR---------------TMSFFEDPTKKVRKPYTITKSRENWTEQE
SEQ ID NO: 12     SSDGFGSIPATGRTS----------------TVSFSEDPTTKIRKPYTIKKSRENWTDQE
SEQ ID NO: 134    GVNNLPPPPPAPPS-----------------HAAVEDPSKKIRKPYTITKSRESWTEQE
SEQ ID NO: 136    GVNNLPPPPPAPAA-----------------PSAVEDPNKKIRKPYTITKSRESWTEQE
SEQ ID NO: 66     ------------------------------------------------------------
SEQ ID NO: 126    NPPPPPALSEAAA------------------AVSGDDASKKVRKPYTITKSRESWTEQE
SEQ ID NO: 42     NTNNNSNSSSSS-----------------------EMPGKKARKPYTITKPRERWSEEE
SEQ ID NO: 52     ----MAAMAAAA-----------------------AGTKKKARKPYTITRPRERWSAEE
SEQ ID NO: 96     -MDP--YSSGEE---------------------------LVVKTRKPYTITKQRERWTEEE
SEQ ID NO: 122    -MDAAAYSSGED---------------------------VVLKTRKPYTITKQRERWTEDE
SEQ ID NO: 84     -MET--CSSGEE---------------------------LVIKPRKPYTITKQREKWTEEE
SEQ ID NO: 86     -MET--CSSGEE---------------------------LIVKPRKPYTITKQREKWTEEE
SEQ ID NO: 90     -MDA--YSSGEE---------------------------VVKTRKPYTITKQRERWTEEE
SEQ ID NO: 98     -MDA--YSSGEE---------------------------VVAKTRKPYTITKQRERWTEEE
SEQ ID NO: 92     -MDA--DSSGEE---------------------------VVIKTRKPYTITKQRERWTEEE
SEQ ID NO: 88     -MDT--YSSGEE---------------------------LVIKARKPYTITKQRERWTEDE
SEQ ID NO: 94     -MEA--YSSGEE---------------------------LVIKTRKPYTITKQRERWTEEE
SEQ ID NO: 4      -MDT--NTSGEE---------------------------LLAKARKPYTITKQRERWTEDE
SEQ ID NO: 100    -MDA--ISSGED---------------------------FILKTRKPYTITKQREKWTEEE
SEQ ID NO: 104    -MDV--NSSGEE---------------------------FVLKTRKPYTITKQRERWTEEE
SEQ ID NO: 2      -MET--NSSGED---------------------------LVIKTRKPYTITKQRERWTEEE
SEQ ID NO: 72     -MEI--NSSGEE---------------------------AVVKVRKPYTITKQRERWTEAE
SEQ ID NO: 102    -MEV--NSSGEE---------------------------TVVKVRKPYTITKQRERWTEAE
SEQ ID NO: 16     SNEGINPETSSHWIEN-----------------------VVKVRKPYTVTKQREKWSEEE
SEQ ID NO: 24     SNEGINPETSSHWIEN-----------------------VVKVRKPYTVTKQREKWSEEE
SEQ ID NO: 78     NYGDMDLSGEEH---------------------------VPKARKPYTITKQREKWTDEE
SEQ ID NO: 108    SSHDMDLSGDDH---------------------------VPKARKPYTITKQREKWTEEE
SEQ ID NO: 80     DSSGMDMMDEAR---------------------------IPKARKPYTITKQREKWTEDE
SEQ ID NO: 34     CSDELISSSDAF---------------------------YLKTRKPYTITKQREKWTEAE
SEQ ID NO: 112    HSNAEKQAENVA---------------------------PKVRKPYTITKQREKWTEEE
SEQ ID NO: 114    HSNGEKQSENVAHIPSVG-----------------NNQTPKVRKPYTITKQREKWTEEE
SEQ ID NO: 116    YLLLETTK-------------------------------TPKVRKPYTITKQREKWTEEE
SEQ ID NO: 82     AMQPNEGMEEFP---------------------------VKVRKPYTITKQREKWTEEE
SEQ ID NO: 110    QLNDQFSCGNDY---------------------------ALKVRKPYTITKQRERWTDEE
SEQ ID NO: 118    -----------------------------------------RGKPYTITKQRERWTDEE
SEQ ID NO: 106    PLHDQLSCGNDY---------------------------ALKVRKPYTITKQRERWTDEE
SEQ ID NO: 132    ----------------------------------------------FTKQXXRWTDEE
SEQ ID NO: 120    TNDATSDPTTTEG--------------------------KAVKTRKPYTITKKRERWSDEE
SEQ ID NO: 18     TVIVADGYASAN-----------------------DAVQISSSSG--GRKRGVPWTENE
SEQ ID NO: 22     NKTPAG-YASAD-----------------------EALPMSSSNGKIERKRGVPWTEEE
SEQ ID NO: 30     NLHHNEGYLSDD-----------------------PAHGSGSSHRRGERKRGVPWTEEE
SEQ ID NO: 44     GGEGAAGYASDD-----------------------PTHASCSTNGRGERKKGTPWTEEE
SEQ ID NO: 36     DHVAGDGYASED-----------------------FVAGSSSS---RERKKGTPWTEEE
SEQ ID NO: 74     --TAADGYASDD-----------------------FVQGSSSAT--RDRKKGVPWTEEE
SEQ ID NO: 20     ------GYASDD-----------------------VVHASGRN---RERKRGTPWTEEE
SEQ ID NO: 68     ---REEGYGSDG-----------------------NDD--------KRRKRGEAWSEEE
SEQ ID NO: 46     EK-MANGYLSDG-----------------------LMA------RAQERKKGVPWTEEE
SEQ ID NO: 54     ER-VSNGYLSDG-----------------------LMG------RVQERKKGVPWTEEE
SEQ ID NO: 48     LERASNGYLSDG-----------------------PHG-----RIVQERKKGVPWSEEE
SEQ ID NO: 56     ERPAADGYLSDG-----------------------PHGAA---ATMRERKKGVPWSEQE
SEQ ID NO: 38     ---SFAGYLSDG-----------------------LAH------KTPDRKKGVPWTAEE
SEQ ID NO: 40     AAVDDTGYHSDG-----------------------QIHSK-KGKTAHEKKKGKPWTEEE
SEQ ID NO: 70     AGGSGDGYLSDGG----------------------LLLSSGKRRRAQERKKAVPWTEEE
SEQ ID NO: 76     RRASDDSELASG-----------------------QQKRRRKVQERKKGVPWTEEE
SEQ ID NO: 26     GKYPLPKYPED--------------------DYVSLPEATKSKTQGTGKKKGIPWSPEE
SEQ ID NO: 32     GKYVLPKYPED--------------------DYVKLTEAGESK--GNGKKTGIPWSEEE
SEQ ID NO: 28     MKYMYEKMANDVNQ---------------MPEYVPLAESSQSK--RRKKDTPNPWTEEE
SEQ ID NO: 62     GMVHGGAAMEVG------------AVAVNGGDGEVVNPD--------NADDDVLWTDYE
SEQ ID NO: 64     GMVFGGAPMEEG------------AVAVNGGDGEVVNPD--------NADDDVLWTDYE
SEQ ID NO: 60     AMVFGGAPMGETVEQAAPPVPVV--PVVMNRDDDEVNNQGGGRHRAAPTNTTRRFWTTEE
SEQ ID NO: 58     KMVVEEEVQPKE------------GLVIKEKEAGVSKIHTNSQHVTPSIKRRVIWTEEE
SEQ ID NO: 50     NAAATSAPTIGG------------GVVLKSRE--LKNPRKTRMAGGGPRKKAEMWTREE
```

FIGURE 2 B (continued)

```
SEQ ID NO: 6     HDKFLEALQLFDR-DWKKIED-FVGSKTVIQIRSHAQKYFLKVQKNGTLAH---------
SEQ ID NO: 14    HDKFLEALQLFDR-DWKKIED-FVGSKTVIQIRSHAQKYFLKVQKNGTLAH---------
SEQ ID NO: 138   HDKFLEALQLFDR-DWKKIED-FVGSKTVIQIRSHAQKYFLKVQKNGTVAH---------
SEQ ID NO: 128   HDKFLEALQLFDR-DWKKIEA-FVGSKTVIQIRSHAQKYFLKVQKSGTNEH---------
SEQ ID NO: 130   HDKFLEALQLFDR-DWKKIEA-FVGSKTVIQIRSHAQKYFLKVQKSGTNEH---------
SEQ ID NO: 124   HDKFLEALQLFDR-DWKKIEA-FIGSKTVIQIRSHAQKYFLKVQKNGTSEH---------
SEQ ID NO: 8     HDKFLEALQLFDR-DWKKIEA-FIGSKTVIQIRSHAQKYFLKVQKSGTGEH---------
SEQ ID NO: 10    HDKFLEALHLFDR-DWKKIKA-FVGSKTVIQIRSHAQKYFLKVQKNGTKEH---------
SEQ ID NO: 12    HDKFLEALHLFDR-DWKKIEA-FVGSKTVVQIRSHAQKYFLKVQKSGANEH---------
SEQ ID NO: 134   HDKFLEALQLFDR-DWKKIEA-FVGSKTVIQIRSHAQKYFLKVQKKGTSEH---------
SEQ ID NO: 136   HDKFLEALQLFDR-DWKKIEA-FVGSKTVIQIRSHAQKYFLKVQKNGTSEH---------
SEQ ID NO: 66    ------------------------------------------------------------
SEQ ID NO: 126   HDKFLEALQLFDR-DWKKIEA-FVGSKTVIQIRSHAQKYFLKVQKNGTSEH---------
SEQ ID NO: 42    HERFLDALIMYGR-DWKKIEE-HVGTKTTIQIRSHAQKYFLKVQKMGLAAG---------
SEQ ID NO: 52    HERFLDALILFGR-DWKRIEA-FVATKTAIQIRSHAQKHFLKARKFGLAGG---------
SEQ ID NO: 96    HNRFLEALKLYGR-AWQRIEE-HIGTKTAVQIRSHAQKFFTKLEKEALTKG------VPT
SEQ ID NO: 122   HNRFLEALKLYGR-AWQRIEE-HIGTKTAVQIRSHAQKFFSKVDWYPLS-----------
SEQ ID NO: 84    HNRFLEALKLYGR-AWQRIEE-HIGTKTAVQIRSHAQKFFTKLEKEAVSKG------VPL
SEQ ID NO: 86    HNRFLEALKLYGR-AWQRIEE-HIGTKTAVQIRSHAQKFFTKLEKEAVSKG------VPL
SEQ ID NO: 90    HNRFLEALKLHGR-AWQRIEE-HIGTKTAVQIRSHAQKFFTKLEKEALVKG------VPI
SEQ ID NO: 98    HNRFLEAXKLHGR-PWQRIEE-HIGTKTAVQIRSHAQKFFTKLEKEALVKG------VPI
SEQ ID NO: 92    HNRFLEALKLYGR-AWQRIEE-HIGTKTAVQIRSHAQKFFTKLEKEAFVKG------VPI
SEQ ID NO: 88    HNRFLEALKLYGR-AWQRIEE-HIGTKTAVQIRSHAQKFFSKLEKEALVKG------VPI
SEQ ID NO: 94    HNRFLEALKLYGR-AWQRIEE-HIGTKTAVQIRSHAQKFFSKLEKEALVKG------VPI
SEQ ID NO: 4     HERFLEALRLYGR-AWQRIEE-HIGTKTAVQIRSHAQKFFTKLEKEAEVKG------IPV
SEQ ID NO: 100   HRKFLEALKLYGR-SWQRIEE-HIGTKTAVQIRSHAQKFFSKLEKEAVIKG------VPL
SEQ ID NO: 104   HNKFLQALKLYGR-SWQRIEE-HIGSKTAVQIGSHAQKFFSKLEKEALIKG------VPL
SEQ ID NO: 2     HNRFIEALRLYGR-AWQKIEE-HVATKTAVQIRSHAQKFFSKVEKEAEAKG------VAM
SEQ ID NO: 72    HNRFLEALKLYGR-AWQRIEE-HVGTKTAVQIRSHAQKFFTKLEKEAINNG------TSP
SEQ ID NO: 102   HKRFLEALKLYGR-AWQRIEE-HVGTKTAVQIRSHAQKFFTKLEKEAMNNG------TSP
SEQ ID NO: 16    HDRFLEAIKLYGR-GWRQIQE-HIGTKTAVQIRSHAQKFFSKMAQEADS--------RSE
SEQ ID NO: 24    HDRFLEAIKLYGR-GWRQIQE-HIGTKTAVQIRSHAQKFFSKMAQEADS--------RSE
SEQ ID NO: 78    HRLFLEALQLHGR-AWRRIQE-HIGTKTAVQIRSHAQKFFSKVVRESSGSNTGSGGASAA
SEQ ID NO: 108   HKRFLEALQLHGR-AWRRIQE-HIGTKTAVQIRSHAQKFFSKVTRESSGSCSGSG-AAAA
SEQ ID NO: 80    HKLFLEALQLHGR-AWRRIQE-HIGTKTAVQIRSHAQKFFSKVIKESSGDN-----CNSL
SEQ ID NO: 34    HEKFVEALKLYGR-AWRRIEE-HVGTKTAVQIRSHAQKFFTKVAR-----------DFG
SEQ ID NO: 112   HQKFLEALKLYGR-GWRQIEE-HIGTKTAVQIRSHAQKFFSKVVRESEV--------SDE
SEQ ID NO: 114   HQKFLEALKLYGR-GWRQIEE-HIGTKNAVQIRSHAQKFFSKVVRESEG--------SAE
SEQ ID NO: 116   HQKFLEALKLYGR-GWRQIEE-HIGTKNAVQIRSHAQKFFSKVVRESEG--------SAE
SEQ ID NO: 82    HDKFLEALKLYGR-SWRQIEE-HIGTKTAVQIRSHAQKFFSKVVREP-------------
SEQ ID NO: 110   HKKFLEALKLYGR-AWRRIEE-HVGTKTAVQIRSHAQKFFSKVLHDPTG--------NNT
SEQ ID NO: 118   HKKFLEALKLYGR-AWRRIEE-HVGTKTAVQIRSHAQKFFSKLLRDPTG--------NNT
SEQ ID NO: 106   HKKFLEALKLYGR-AWRRIEE-HVGTKTAVQIRSHAQKFFSKILRESSG--------NST
SEQ ID NO: 132   HKKFLEALKLYGR-AWRKIEE-HVGTKTAVQIRSHAQKFFSKINRDTNG--------NDT
SEQ ID NO: 120   HALFVESLKKYGR-AWRKIEE-YIGTKSAVQIRSHAQKFFAKLQKEQIVAS------GSE
SEQ ID NO: 18    HKRFLIGLQKVGKGDWKGISRNFVKSRTPTQVASHAQKYFLRRTNLNRR-----------
SEQ ID NO: 22    HKLFLLGLQRVGKGDWKGISRNFVKTRTSTQVASHAQKYFLRRSNLNRR-----------
SEQ ID NO: 30    HRLFLVGLQKLGKGDWRGISRNYVTSRTPTQVASHAQKYFIRHTSSSRR-----------
SEQ ID NO: 44    HRMFLMGLQKLGKGDWRGISRNFVVSRTPTQVASHAQKYFIRQTNSSRR-----------
SEQ ID NO: 36    HRMFLLGLQKLGKGDWRGISRNYVTTRTPTQVASHAQKYFIRQSNVSRR-----------
SEQ ID NO: 74    HRRFLLGLQKLGKGDWRGISRNFVVSRTPTQVASHAQKYFIRQSNMTRR-----------
SEQ ID NO: 20    HRLFLTGLHKVGKGDWRGISRNFVKTRTPTQVASHAQKYFLRRTNQNRR-----------
SEQ ID NO: 68    HKKFLLGLSKLGKGDWRGISRNYVGSRTPTQVASHAQKYFIRQTNVHRR-----------
SEQ ID NO: 46    HRKFLVGLEKLGKGDWRGISRHFVTTRTPTQVASHAQKYFLRQSSLTQK-----------
SEQ ID NO: 54    HQMFLAGLDKLGKGDWRGISRHFVTTRTPTQVASHAQKYFLRQNSMTQK-----------
SEQ ID NO: 48    HRLFLVGLEKLGKGDWRSYVTTRTPTQVASHAQKYFLRQSSIGKK-----------
SEQ ID NO: 56    HRLFLAGLEKLGKGDWRGISRSFVTTRTPTQVASHAQKFFLRHNSAAKKTNN--------
SEQ ID NO: 38    HRTFLIGLEKLGKGDWRGISRNFVVTKSPTQVASHAQKYFLRQTTTLHHK----------
SEQ ID NO: 40    HRNFLIGLNKLGKGDWRGIAKSFVSTRTPTQVASHAQKYFIRLNVNDKR-----------
SEQ ID NO: 70    HRTFLAGLEKLGKGDWRGISKNFVTTRTPTQVASHAQKYFLRQTNPNKK-----------
SEQ ID NO: 76    HKKFLEGLRQLGKGDWRGISKNFVSRTATQVASHAQKYFLRQTNPGKK-----------
SEQ ID NO: 26    HRLFLDGLNKYGKGDWKSISRECVTSRSPMQVASHAQKYFLRQKNK--K-----------
SEQ ID NO: 32    QRLFLEGLNKFGKGDWKNISRYCVKSRTSTQVASHAQKYFARQKQESTN-----------
SEQ ID NO: 28    HRLFLQCLKKYCECASTLTSTNFVKTKTPRQVSSHAQ-YYKRQKSDNKK-----------
SEQ ID NO: 62    HRLFLTGMRVYGRGDWRNISRYFVRSKTPEQISMYADNYFHMMEIAAA------------
SEQ ID NO: 64    HRLFLTGMRVYGRGDWRNIARYFVGSKTPEQVSMYADNYFHMMEIAAA------------
SEQ ID NO: 60    HRQFLRGLRVYGRGEWKSISMNFVRSKTPVQVSSHAQKYFRRVESAAADKQRYS------
SEQ ID NO: 58    HRLFMVGLRVFGRGDWKNISKHLVTTRTAAQVSSHAQKFFLKMEARGE------------
SEQ ID NO: 50    HSQFLHGISTYGKGNWKALASEFVKTKSSTQIASHYQKFCIREEKRRL------------
```

FIGURE 2 B (continued)

```
SEQ ID NO: 6       -------VPPPRPK-------------------------------RKAAHPYP------
SEQ ID NO: 14      -------VPPPRPK-------------------------------RKAAHPYP------
SEQ ID NO: 138     -------VPPPRPK-------------------------------RKAAHPYP------
SEQ ID NO: 128     -------LPPPRPK-------------------------------RKAAHPYP------
SEQ ID NO: 130     -------LPPPRPK-------------------------------RKAAHPYP------
SEQ ID NO: 124     -------LPPPRPK-------------------------------RKAAHPYP------
SEQ ID NO: 8       -------LPPPRPK-------------------------------RKAAHPYP------
SEQ ID NO: 10      -------LPPPRPK-------------------------------RKANHPYP------
SEQ ID NO: 12      -------LPPPRPK-------------------------------RKASHPYP------
SEQ ID NO: 134     -------VPPPRPK-------------------------------RKAARPYP------
SEQ ID NO: 136     -------VPPPRPK-------------------------------RKAAHPYP------
SEQ ID NO: 66      ------------------------------------------------------------
SEQ ID NO: 126     -------VPPPRPK-------------------------------RKAAHPYP------
SEQ ID NO: 42      -------LPPQYPR-------------------------------RRLVMQQQQQQSSP
SEQ ID NO: 52      -------LPPPLHP-------------------------------RRATLLR-------
SEQ ID NO: 96      SQALDIEIPPPRPKRKPSNPYPRKTSAAGHSSQVGAKDGKYSTTFSSICEER-NLFDLEK
SEQ ID NO: 122     ---------PP----------------------------------NLCSNF-FLFLLGK
SEQ ID NO: 84      GQVHDIDIPPPRPK-------------------------------RKPNNP-YPRKLGV
SEQ ID NO: 86      GQVHDIEIPPPRPK-------------------------------RKPTNP-YPRKIGV
SEQ ID NO: 90      GQALDIDIPPPRPK-------------------------------RKPSNP-YPRKTTI
SEQ ID NO: 98      GHALDIDISPPRPK----------------------------------------------
SEQ ID NO: 92      GQALDIDIPPPRPK-------------------------------RKPNNP-YPRKTNV
SEQ ID NO: 88      GQALDIDIPPPRPK-------------------------------RKPSNP-YPRKTSI
SEQ ID NO: 94      QQALDIEIPPPRPK-------------------------------RKPSNP-YPRKTGA
SEQ ID NO: 4       CQALDIEIPPPRPK-------------------------------RKPNTP-YPRKPGN
SEQ ID NO: 100     GQAHGIEIPPPRPK-------------------------------RKPNIP-YPRK--I
SEQ ID NO: 104     GQGQGIEIPPPRPK-------------------------------RKPNNP-YPLKTSI
SEQ ID NO: 2       GQALDIAIPPPRPK-------------------------------RKPNNP-YPRKTGS
SEQ ID NO: 72      GQAHDIDIPPPRPK-------------------------------RKPNSP-YPRKSCL
SEQ ID NO: 102     GQAHDIDIPPPRPK-------------------------------RKPNSP-YPRKSCL
SEQ ID NO: 16      GSVKAIVIPPPRPK-------------------------------RKPAHP-YPRKSPV
SEQ ID NO: 24      GSVKAIVIPPPRPK-------------------------------RKPAHP-YPRKSPV
SEQ ID NO: 78      AAAAATQTPPPRPK-------------------------------RKPAHP-YPRKVDG
SEQ ID NO: 108     TATAAIQIPPPRPK-------------------------------RKPTHP-YPRKADD
SEQ ID NO: 80      GAASSIQIPPPRPK-------------------------------RKPVHP-YPRNLGS
SEQ ID NO: 34      VSSESIEIPPPRPK-------------------------------RKPMHP-YPRKLVI
SEQ ID NO: 112     GSIQPINIPPPRPK-------------------------------RKPLHP-YPRKSVN
SEQ ID NO: 114     SSIQPINIPXPRPK-------------------------------RKPLHP-YPRKSVN
SEQ ID NO: 116     SSIQPINIPPPRPK-------------------------------RKPLQSIFPR----
SEQ ID NO: 82      GSNNAIEIPPPRPK-------------------------------RKPLHP-YPRKCAN
SEQ ID NO: 110     NTVESIEIPPPRPK-------------------------------RKPMHP-YPRKLVE
SEQ ID NO: 118     NTVESIEIPPPRPK-------------------------------RKPVHP-YPRKLVE
SEQ ID NO: 106     TLEESIEIPPPRPK-------------------------------RKPIHP-YPRKLVE
SEQ ID NO: 132     TLVESI------------------------------------------------------
SEQ ID NO: 120     GSGSTRKRGADRSTSQ-----------------------------SKRSKSSYATDINL
SEQ ID NO: 18      ------------------------------------------------------------
SEQ ID NO: 22      ------------------------------------------------------------
SEQ ID NO: 30      ------------------------------------------------------------
SEQ ID NO: 44      ------------------------------------------------------------
SEQ ID NO: 36      ------------------------------------------------------------
SEQ ID NO: 74      ------------------------------------------------------------
SEQ ID NO: 20      ------------------------------------------------------------
SEQ ID NO: 68      ------------------------------------------------------------
SEQ ID NO: 46      ------------------------------------------------------------
SEQ ID NO: 54      ------------------------------------------------------------
SEQ ID NO: 48      ------------------------------------------------------------
SEQ ID NO: 56      ------------------------------------------------------------
SEQ ID NO: 38      ------------------------------------------------------------
SEQ ID NO: 40      ------------------------------------------------------------
SEQ ID NO: 70      ------------------------------------------------------------
SEQ ID NO: 76      ------------------------------------------------------------
SEQ ID NO: 26      ------------------------------------------------------------
SEQ ID NO: 32      ------------------------------------------------------------
SEQ ID NO: 28      ------------------------------------------------------------
SEQ ID NO: 62      ----------ME------------------------------------------------
SEQ ID NO: 64      ----------ME------------------------------------------------
SEQ ID NO: 60      ----------IN------------------------------------------------
SEQ ID NO: 58      ------------------------------------------------------------
SEQ ID NO: 50      ------------------------------------------------------------
```

FIGURE 2 B (continued)

```
SEQ ID NO: 6      ------------------------------------------------------QKAS
SEQ ID NO: 14     ------------------------------------------------------QKAS
SEQ ID NO: 138    ------------------------------------------------------QKAS
SEQ ID NO: 128    ------------------------------------------------------QKAS
SEQ ID NO: 130    ------------------------------------------------------QKAS
SEQ ID NO: 124    ------------------------------------------------------QKAS
SEQ ID NO: 8      ------------------------------------------------------QKAH
SEQ ID NO: 10     ------------------------------------------------------QKAP
SEQ ID NO: 12     ------------------------------------------------------IKAP
SEQ ID NO: 134    ------------------------------------------------------QKAP
SEQ ID NO: 136    ------------------------------------------------------QKAP
SEQ ID NO: 66     ----------------------------------------------------------
SEQ ID NO: 126    ------------------------------------------------------QKAS
SEQ ID NO: 42     AVS------------------------------------------------SSVAAT
SEQ ID NO: 52     ----------------------------------------------------ANAAAA
SEQ ID NO: 96     EPITEKPGGNEKLGNVKETQNKKNCSQGLTKEGASAASMSSGKSLQAHVAPTDVCAFSES
SEQ ID NO: 122    ---------------------NSSP------------------------------TSD
SEQ ID NO: 84     GP-------------------TCPSGSERED------------------------NKT
SEQ ID NO: 86     GP-------------------SYPSGGERDD------------------------NRQ
SEQ ID NO: 90     G--------------------TATLHSG-AKDGN---------------------LV
SEQ ID NO: 98     ----------------------------------------------------------
SEQ ID NO: 92     GG-------------------APTLHSG-ARHGKP--------------------LISI
SEQ ID NO: 88     G--------------------VPTSQVG-TKDGKL--------------------FTSA
SEQ ID NO: 94     AG-------------------SPSTQIK-VKDGNK--------------------VPPG
SEQ ID NO: 4      NG-------------------TSSSQVSSAKDAKL--------------------VSSA
SEQ ID NO: 100    SS-------------------DIDGSHQ---------------------------KVA
SEQ ID NO: 104    SN-------------------GIGGLHQ---------------------------KKA
SEQ ID NO: 2      GT-------------------ILMSKTGVNDGK----------------------ESL
SEQ ID NO: 72     SS-------------------ETSTR----------------------------EV
SEQ ID NO: 102    SS-------------------ETQTK----------------------------EL
SEQ ID NO: 16     P---------------------------------------------------------
SEQ ID NO: 24     P---------------------------------------------------------
SEQ ID NO: 78     ------------------------------------------------------AAKKH
SEQ ID NO: 108    GAA---------------------------------------------------AGGKH
SEQ ID NO: 80     ------------------------------------------------------TASKN
SEQ ID NO: 34     P-------------------------------------------------------D
SEQ ID NO: 112    S-----------------------------------------------------FRGP
SEQ ID NO: 114    S-----------------------------------------------------FRGP
SEQ ID NO: 116    ----------------------------------------------------------
SEQ ID NO: 82     S-----------------------------------------------------GSDA
SEQ ID NO: 110    T-----------------------------------------------------PNKE
SEQ ID NO: 118    T-----------------------------------------------------PNKE
SEQ ID NO: 106    F-----------------------------------------------------PKTG
SEQ ID NO: 132    ----------------------------------------------------------
SEQ ID NO: 120    EIP-----------------------------------------------------PA
SEQ ID NO: 18     ----------------------------------------------------------
SEQ ID NO: 22     ----------------------------------------------------------
SEQ ID NO: 30     ----------------------------------------------------------
SEQ ID NO: 44     ----------------------------------------------------------
SEQ ID NO: 36     ----------------------------------------------------------
SEQ ID NO: 74     ----------------------------------------------------------
SEQ ID NO: 20     ----------------------------------------------------------
SEQ ID NO: 68     ----------------------------------------------------------
SEQ ID NO: 46     ----------------------------------------------------------
SEQ ID NO: 54     ----------------------------------------------------------
SEQ ID NO: 48     ----------------------------------------------------------
SEQ ID NO: 56     ----------------------------------------------------------
SEQ ID NO: 38     ----------------------------------------------------------
SEQ ID NO: 40     ----------------------------------------------------------
SEQ ID NO: 70     ----------------------------------------------------------
SEQ ID NO: 76     ----------------------------------------------------------
SEQ ID NO: 26     ----------------------------------------------------------
SEQ ID NO: 32     ----------------------------------------------------------
SEQ ID NO: 28     ----------------------------------------------------------
SEQ ID NO: 62     ----------------------------------------------------------
SEQ ID NO: 64     ----------------------------------------------------------
SEQ ID NO: 60     ----------------------------------------------------------
SEQ ID NO: 58     ----------------------------------------------------------
SEQ ID NO: 50     ----------------------------------------------------------
```

FIGURE 2 B (continued)

```
SEQ ID NO:   6   KNAQMSLHVSMSFPTQIN-NLPGYTPWDDDTSALLNIAVSGVIPPEDELDTLC-GAEVDV
SEQ ID NO:  14   KNAQMPLQVSTSFTTTRNCDMPGYASWDD-ASMLLNRVIS----PQHELATLR-CAEADI
SEQ ID NO: 138   KNVLVPLPASIGYASSRNTLAPGFASWDE-TSLLMNAGADKPMTCQDELNNLHHGNEADI
SEQ ID NO: 128   KTG---------------YSLHYIFFFCYTI-----------------------------
SEQ ID NO: 130   KTAPVLSQVSGSFQSSSALLEPGYILKHDSSAMPKTPIINTAVSSWSNNSLQKT-----T
SEQ ID NO: 124   KNALALPPVSWSCQSSSALLESGFNQRPDSSSMLMSPIPGPVAPSWPNGSVQTANPSHES
SEQ ID NO:   8   KNVQLQVP--GSFKSTSEPNDPSFMFRPESSSMLMTSPTTAAAAPWTNNAQTIS----FT
SEQ ID NO:  10   K---------FTLSSSNALFQHDYLYNTNS-----HPVISTTRKHGLVHCDVSIP---SS
SEQ ID NO:  12   KN---VAYTSLPSSSTLPLLEPGYLYSSDSKSLMGNQAVCASTSSSWNHESTNLP---KP
SEQ ID NO: 134   KTP-TVSQVMGPLQSSSSFIEPAYIYIPDSSSALGTPVTNMPSSS-WNYNNTPQSVNVPQ
SEQ ID NO: 136   KTP-TVSQVMGPLQSSSAFIEPAYIYSPDSSSVLGTPVTNMPLSS-WNYNTTPQPGNVPQ
SEQ ID NO:  66   -----------------------MSMDTSPVIRNTNASAVVPSWDNSIAQPLSAS---
SEQ ID NO: 126   KNE---------------PGYALKTDPSAMLRNSGMNVAVSPWTHNSIPPVVASSFM
SEQ ID NO:  42   AILHGQPQCLPPHHNVAVQSSIGWECPGVLPPATNDMQNLEWASTSGTAAWGNHHGLIEP
SEQ ID NO:  52   DMMP------PPWLPSAGGGSIGCSAP--PSGVQQSMAGRSPACYSTDEAS--FRPLIHS
SEQ ID NO:  96   VSVTKGVVNNDNANKSFLIVESKEHQQSEILDIRQSFQGNSSCNTFDGGKSCQSSEKLAQ
SEQ ID NO: 122   IRLLMGV-----------------------------------------------------
SEQ ID NO:  84   LTHLP--SLNSKGKAEDS-PESSHENQAGIKPDKKTPESPVILSLFHVAPPPSTPS----
SEQ ID NO:  86   LTHLPSSSLHSKGKAEDFFVDSSPEKQAGMNSEKITKEAPVALSLFHVAPSSPTPS----
SEQ ID NO:  90   ESSHNNQA-LDLEKEPLPEKYDLDEGLTTVKENK-DENCSKVFKVIQEVPCSSISSANRS
SEQ ID NO:  98   -----------------------------------------------------------
SEQ ID NO:  92   VSSLGXQA-LGLEKEPLPEKHDVDLRPSTVKENK-DQSCSKVF-----------------
SEQ ID NO:  88   SSSDCXQA-LDLEKEPLPEKPNCDEKPENAKDNQ-DDNCSEVFTLHQEVHCSSVSSANRS
SEQ ID NO:  94   SSHTANQL-LDLEKEPPPENTTGDDGKQNAKETCGAYKCSETFTLFQEAPSTLTASGNEN
SEQ ID NO:   4   SSSQLNQAFLDLEKMPFSEKTS------TGKENQ-DENCSGVSTVNKYPLPTKQVSGDIE
SEQ ID NO: 100   SDEDKCFMGLALFQDSPCTTKPSSDVDLGRFEGLSIDSCVRKGDAKSTSHGGSMSG----
SEQ ID NO: 104   SS-DEDLLGLSLFHDPSCKTKPSPDVELGRFEGLRIDTSLKKGDSKPKSISGTTSG----
SEQ ID NO:   2   GSEKVSHPEMANEDRQQSKPEEKTLQEDNCSDCFTHQYLSAASSMNKSCIETSNAS----
SEQ ID NO:  72   QNDKATISNMTN-NSTAQMAGDAALEKLQRKEISEKGSCSEVLNLFREVPSASFSSVNKS
SEQ ID NO: 102   PNDKSTKPNMPLSNGHVKMVGDASLQNFQRKELSEKGSRSEVLNLFRDAPSASFSSVNKS
SEQ ID NO:  16   ------YTQSPPPNLSAMEKGTKSPTSVLSSFGSEDQVNRCSSPNSCTSDIQSIGATSID
SEQ ID NO:  24   ------YTQSPPPNLSAMEKGTKSPTSVLSSFGSED-----------------------
SEQ ID NO:  78   VPALRQLEXPPLWMQSLSEQEEGSPTSVLTAAQIGTEALGGGFSNNSSGSGSLAPSAAGT
SEQ ID NO: 108   APGLTHLERPPVRMG---EQEEGSPTSVLTASRV--EASGGRFSYNSSGSRSPVPSAAGS
SEQ ID NO:  80   VPALKQLEXPQLQVQSLYDQDNGSPTSVLTVPQIRADTLGSESGGSPTSTIDIEERCPTP
SEQ ID NO:  34   AKEMVYAELTGSKLIQ--DEDNRSPTSVLSAHGS--DGLGSIGSNSPNSS----------
SEQ ID NO: 112   -TIPNET-----------------------------------------------------
SEQ ID NO: 114   -TIPNETEISPSTNLLVAEKDTPSPTSVLSTVGS--EAFGSQFSEQTNRCLSPNSCTTDI
SEQ ID NO: 116   -----------------------------------------------------------
SEQ ID NO:  82   NPATAQLKLAPGSSSSGSDQENGSPISVLSAMQS--DAFGSSVSNPSTRCTSPASSDDGN
SEQ ID NO: 110   ISIPEQPMKSNSLKSSDFDQENQSPKSVLSGVGS--DSLGSSDSDTPNGSLSPMSSISGF
SEQ ID NO: 118   ILIPEQLMKSNSLKSSDFDQENQSPKSVLSGVGS--DSLGSSDSDTPYGSLSPMSSISGI
SEQ ID NO: 106   ISNSEHPLRSNSLKSSDFGQENNSPKSVLSTVVS--ETVGSSDSDTSSRCLSPASSISGV
SEQ ID NO: 132   -----------------------------------------------------------
SEQ ID NO: 120   RPKKKPAHPYPRKATSQQPSGGSGERDNSGGTGKSSGTAQKWPTEASQEFIASTSS----
SEQ ID NO:  18   ------------------RRRSSLFDITTETVTEMAME---------------------
SEQ ID NO:  22   ------------------RRRSSLFDMTTDTVIPMEEDHQ-------------------
SEQ ID NO:  30   ------------------KRRSSLFDMVTDEMVTDSSP---------------TQEEQ
SEQ ID NO:  44   ------------------KRRSSLFDMVP-EMPMDESPVV------VEQLMHSTQDEA
SEQ ID NO:  36   ------------------KRRSSLFDMVPDEVGDIPMDLQFPEEDNIPVETEMQGADSI
SEQ ID NO:  74   ------------------KRRSSLFDMVPDES----MDLP-------PLP---GGQEPE
SEQ ID NO:  20   ------------------RRRSSLFDITPDSFIG-------------------SSKEE
SEQ ID NO:  68   ------------------KRRSSLFDMVIDDSDDQPLSRTSSQEVEVEENLEDGHPVTA
SEQ ID NO:  46   ------------------KRRSSLFDVIEDAEKAPSVNER-------------------
SEQ ID NO:  54   ------------------KRRSSLFDVVEGIKRAAAM---------------------
SEQ ID NO:  48   ------------------KRRSSLFDMVPICENGARV----------------------
SEQ ID NO:  56   ------------------KRRSSLFDMVQDCDSGGR----------------------
SEQ ID NO:  38   ------------------RRRTSLFDMVSAGN--------------------------
SEQ ID NO:  40   ------------------KRRASLFDISLEDQKEKERNSQ------------------
SEQ ID NO:  70   ------------------KRRSSLFDMMATDMSPAPNCPV------------------
SEQ ID NO:  76   ------------------KRRASLFDVVAECSDDQ------------------------
SEQ ID NO:  26   ------------------GKRFSIHDMTLGDAENVTPVS-------------------
SEQ ID NO:  32   ------------------TKRPSIHDMTLG--VAVNVPGS------------------
SEQ ID NO:  28   ------------------EKRRSIFDITLE----------------------------
SEQ ID NO:  62   ---------------ADGCDDDDCHHEINNN---------------------------
SEQ ID NO:  64   ---------------ADG-DDDDDHHENNNNNLGGGQLEAVV-----------------
SEQ ID NO:  60   ---------------DVGLNDDTAAMDGTNS---------------------------
SEQ ID NO:  58   ---------------AVPPPAKRRRRRITGD---------------------------
SEQ ID NO:  50   ---------------SKCKRASIHDIVS------------------------------
```

FIGURE 2 B (continued)

```
SEQ ID NO: 6      GSNDMISETSPSASGIGS------------------------------------------
SEQ ID NO: 14     GSKGLLNVSSPSTSGMGS------------------------------------------
SEQ ID NO: 138    GSKGIAQITNSSLSGVGN------------------------------------------
SEQ ID NO: 128    ------------------------------------------------------------
SEQ ID NO: 130    SVLHGQKQKVNNCCSSSR------------------------------------------
SEQ ID NO: 124    KVVSGPTVLNNSCSTTES------------------------------------------
SEQ ID NO: 8      PLPKGAGANNNCSSSSEN------------------------------------------
SEQ ID NO: 10     VIKEEFGVSEN-CCSTSS------------------------------------------
SEQ ID NO: 12     VIEEEPGVSAT-APLPNNRCR---------------------------------------
SEQ ID NO: 134    VTRDDMGFTVAGQTAPLNCCC---------------------------------------
SEQ ID NO: 136    VTRDDMGLTGAGQAAPLN------------------------------------------
SEQ ID NO: 66     -RTQGTGAVATNN-CSSSI-----------------------------------------
SEQ ID NO: 126    KEDLGAGSMGPNIFCSSSS-----------------------------------------
SEQ ID NO: 42     PAAFVSFPGESSFMGAASFSN---------------------------------------
SEQ ID NO: 52     NDNDCSFIETPSCIGSGGES----------------------------------------
SEQ ID NO: 96     GEKKHPSFQPNHLGEFSRN-----------------------------------------
SEQ ID NO: 122    ------------------------------------------------------------
SEQ ID NO: 84     ------------------------------------------------------------
SEQ ID NO: 86     ------------------------------------------------------------
SEQ ID NO: 90     SISMSVPLGNSCVLKEITSSVKEVITRDENTESFLTVEL-GNRNLEINDGKQAN---GTS
SEQ ID NO: 98     ------------------------------------------------------------
SEQ ID NO: 92     ------------------------------------------------------------
SEQ ID NO: 88     SVPTPVALRNLNTLREFVPSMKRSITQDETNESYVTIELKGNQKLEKADAKQTIQDTGTS
SEQ ID NO: 94     SAITTGATRKSCKVDDPVP--------------------KKLLVDIDGSDCPAADGRQ
SEQ ID NO: 4      TSKTSTVDNAVQDVP--------------------------------------------K
SEQ ID NO: 100    ------------------------------------------------------------
SEQ ID NO: 104    ------------------------------------------------------------
SEQ ID NO: 2      ------------------------------------------------------------
SEQ ID NO: 72     SSNHCASRGLEPTKTEVKD-----------------------------------------
SEQ ID NO: 102    SSNHGAPRRTEASKTESRD-----------------------------------------
SEQ ID NO: 16     ------------------------------------------------------------
SEQ ID NO: 24     ------------------------------------------------------------
SEQ ID NO: 78     DEH--------VDGGGSPA-----------------------------------------
SEQ ID NO: 108    -----------LYG----------------------------------------------
SEQ ID NO: 80     ------------------------------------------------------------
SEQ ID NO: 34     ------------------------------------------------------------
SEQ ID NO: 112    ------------------------------------------------------------
SEQ ID NO: 114    HSVSLSP-----------------------------------------------------
SEQ ID NO: 116    ------------------------------------------------------------
SEQ ID NO: 82     NIPTFTSGEDNNVPCEPTV-----------------------------------------
SEQ ID NO: 110    HTS---------------------------------------------------------
SEQ ID NO: 118    HTS---------------------------------------------------------
SEQ ID NO: 106    PTN---------------------------------------------------------
SEQ ID NO: 132    ------------------------------------------------------------
SEQ ID NO: 120    ------------------------------------------------------------
SEQ ID NO: 18     ------------------------------------------------------------
SEQ ID NO: 22     ------------------------------------------------------------
SEQ ID NO: 30     TLNGSSPS------KEPEKKSYLPSLEISLNNTTEAEEVVATAPRQEKS-----------
SEQ ID NO: 44     TSSNQLPISHLVKQKEPEFARHLSDLQIRKHEESEFTEPSLAALDLEMN-----------
SEQ ID NO: 36     HQTLAPSSLHAPSILEIEECESMDSTNSTTCEPTATAAAASSSSRLEETTQL--------
SEQ ID NO: 74     TQVLNQPALPPP--REEEEVDSMESD---------TSAVAESSS----------------
SEQ ID NO: 20     NQ----------------------------------------------------------
SEQ ID NO: 68     PVIPPAPVPMLSSSLVPPPVPAMAPVAPGPVLTSASATLPVSAVAPQTDEKEQVAS----
SEQ ID NO: 46     ------------------------------------------------------------
SEQ ID NO: 54     ------------------------------------------------------------
SEQ ID NO: 48     ------------------------------------------------------------
SEQ ID NO: 56     ------------------------------------------------------------
SEQ ID NO: 38     ------------------------------------------------------------
SEQ ID NO: 40     ------------------------------------------------------------
SEQ ID NO: 70     ------------------------------------------------LPPSMGKLHD----
SEQ ID NO: 76     ------------------------------------------------LP----------
SEQ ID NO: 26     ------------------------------------------------------------
SEQ ID NO: 32     ------------------------------------------------------------
SEQ ID NO: 28     ------------------------------------------------------------
SEQ ID NO: 62     ------------------------------------------------------------
SEQ ID NO: 64     ------------------------------------------------------------
SEQ ID NO: 60     ------------------------------------------------------------
SEQ ID NO: 58     ------------------------------------------------------------
SEQ ID NO: 50     ------------------------------------------------------------
```

FIGURE 2 B (continued)

```
SEQ ID NO: 6     ----------------------------------------------------------
SEQ ID NO: 14    ----------------------------------------------------------
SEQ ID NO: 138   ----------------------------------------------------------
SEQ ID NO: 128   ----------------------------------------------------------
SEQ ID NO: 130   ----------------------------------------------------------
SEQ ID NO: 124   ----------------------------------------------------------
SEQ ID NO: 8     ----------------------------------------------------------
SEQ ID NO: 10    ----------------------------------------------------------
SEQ ID NO: 12    ----------------------------------------------------------
SEQ ID NO: 134   ----------------------------------------------------------
SEQ ID NO: 136   ----------------------------------------------------------
SEQ ID NO: 66    ----------------------------------------------------------
SEQ ID NO: 126   ----------------------------------------------------------
SEQ ID NO: 42    ----------------------------------------------------------
SEQ ID NO: 52    ----------------------------------------------------------
SEQ ID NO: 96    ---------------------------------------DMQVLHNYPRHVPVHILDGTNGSQIA
SEQ ID NO: 122   ----------------------------------------------------------
SEQ ID NO: 84    ----------------------------------------------SSKSPVS--------SLG
SEQ ID NO: 86    ---------------------------------------SSKSTVPLPDDEKNPSIN
SEQ ID NO: 90    KNSTLENSDALQTKLVQNEKTDGLDSALTIDGMQGNQNYPRHVTVHVVDGKLGTSTQNPS
SEQ ID NO: 98    ----------------------------------------------------------
SEQ ID NO: 92    ----------------------------------------------------------
SEQ ID NO: 88    NGSKLGNHNVLHEKPIQGDKTQDLNCALPMDEMQATQNYPRHVPVQVVDGSLGTCTQTPS
SEQ ID NO: 94    RNQKLDKTDTVETAQNDTEN-----------EMHAVKNFPRHTPVHILDCSLCACSQALS
SEQ ID NO: 4     KNKDKDGNDGTT-------------------VHSMQNYPWHFHADIVNGNIAKCPQNHP
SEQ ID NO: 100   ---------------------------------------------------VTRDQHKA
SEQ ID NO: 104   ---------------------------------------------------TTTDQNAE
SEQ ID NO: 2     ----------------------------------TFREFLPSREEGSQNNRVRKESN
SEQ ID NO: 72    ------------------------------VVILERDSISNGAGKDAKDINDQEMERLNG
SEQ ID NO: 102   ----------------------------MSIMENNSFNPNTQEDVKVISDQEMERLNG
SEQ ID NO: 16    ----------------------------------------------------------
SEQ ID NO: 24    ----------------------------------------------------------
SEQ ID NO: 78    ----------------------------------------------------------
SEQ ID NO: 108   ----------------------------------------------------------
SEQ ID NO: 80    ----------------------------------------------------------
SEQ ID NO: 34    ----------------------------------------------------------
SEQ ID NO: 112   ----------------------------------------------------------
SEQ ID NO: 114   ----------------------------------------------------------
SEQ ID NO: 116   ----------------------------------------------------------
SEQ ID NO: 82    ----------------------------------------------------------
SEQ ID NO: 110   ----------------------------------------------------------
SEQ ID NO: 118   ----------------------------------------------------------
SEQ ID NO: 106   ----------------------------------------------------------
SEQ ID NO: 132   ----------------------------------------------------------
SEQ ID NO: 120   ----------------------------------------------------------
SEQ ID NO: 18    ----------------------------------------------------------
SEQ ID NO: 22    ----------------------------------------------------------
SEQ ID NO: 30    ----------------------------------------------------------
SEQ ID NO: 44    ----------------------------------------------------------
SEQ ID NO: 36    ----------------------------------------------------------
SEQ ID NO: 74    ----------------------------------------------------------
SEQ ID NO: 20    ----------------------------------------------------------
SEQ ID NO: 68    ----------------------------------------------------------
SEQ ID NO: 46    ----------------------------------------------------------
SEQ ID NO: 54    ----------------------------------------------------------
SEQ ID NO: 48    ----------------------------------------------------------
SEQ ID NO: 56    ----------------------------------------------------------
SEQ ID NO: 38    ----------------------------------------------------------
SEQ ID NO: 40    ----------------------------------------------------------
SEQ ID NO: 70    ----------------------------------------------------------
SEQ ID NO: 76    ----------------------------------------------------------
SEQ ID NO: 26    ----------------------------------------------------------
SEQ ID NO: 32    ----------------------------------------------------------
SEQ ID NO: 28    ----------------------------------------------------------
SEQ ID NO: 62    ----------------------------------------------------------
SEQ ID NO: 64    ----------------------------------------------------------
SEQ ID NO: 60    ----------------------------------------------------------
SEQ ID NO: 58    ----------------------------------------------------------
SEQ ID NO: 50    ----------------------------------------------------------
```

FIGURE 2 B (continued)

```
SEQ ID NO: 6      ----------------------------------------------------------
SEQ ID NO: 14     ----------------------------------------------------------
SEQ ID NO: 138    ----------------------------------------------------------
SEQ ID NO: 128    ----------------------------------------------------------
SEQ ID NO: 130    ----------------------------------------------------------
SEQ ID NO: 124    ----------------------------------------------------------
SEQ ID NO: 8      ----------------------------------------------------------
SEQ ID NO: 10     ----------------------------------------------------------
SEQ ID NO: 12     ----------------------------------------------------------
SEQ ID NO: 134    ----------------------------------------------------------
SEQ ID NO: 136    ----------------------------------------------------------
SEQ ID NO: 66     ----------------------------------------------------------
SEQ ID NO: 126    ----------------------------------------------------------
SEQ ID NO: 42     ----------------------------------------------------------
SEQ ID NO: 52     ----------------------------------------------------------
SEQ ID NO: 96     PDMFNHESTSQQINCVPCLPNLYSNPASSTTSEHHSNAPQSSIHQSFSCFHPIFTP----
SEQ ID NO: 122    ----------------------------------------------------------
SEQ ID NO: 84     KGMAEEN-------------NPKICHVDRVNPKLPSPSAISSVHQS--------------
SEQ ID NO: 86     FDLNKKN-------------RPCGVNADPNTVKFPSPSAISSVHQSTAAFP---------
SEQ ID NO: 90     QDMLFRDSMFQPIGGDNGQPNLFTNSAPTNTSESQNNTARSSVHQSFL-PYPPFT-----
SEQ ID NO: 98     ----------------------------------------------------------
SEQ ID NO: 92     ----------------------------------------------------------
SEQ ID NO: 88     SDMSFQDSIFHPMCEVHRHHNPFTNPAASATTEHQNNVPRSVNQSFPA-FHPPFTPI---
SEQ ID NO: 94     SDVSYQESAFHRMG-IPGYPAIFSNPAVSAAVESQNSTSRTTNQQMFTSFHPPFTPF---
SEQ ID NO: 4      SGMVSQDFMFHPMREETHGHANLQATTASATTTASHQAFPAC------------------
SEQ ID NO: 100    KSMPFAAS----------------------------------------------------
SEQ ID NO: 104    KSMQLTAS----------------------------------------------------
SEQ ID NO: 2      SDLNAKSLENGNEQGPCTYPMHIPVLVPLGSSITSSLSHPPSEPDS--------------
SEQ ID NO: 72     IHISSKPDHSHENCLDTSSQQFKPKSNSVETTYVDWSAAKASHYQMDRNGVTGFQATGTE
SEQ ID NO: 102    IQIRSKCEHSHECYLDISTQQMKLMPKSVETTYVDEQTARASHTLAESNCDS--------
SEQ ID NO: 16     ----------------------------------------------------------
SEQ ID NO: 24     ----------------------------------------------------------
SEQ ID NO: 78     ----------------------------------------------------------
SEQ ID NO: 108    ----------------------------------------------------------
SEQ ID NO: 80     ----------------------------------------------------------
SEQ ID NO: 34     ----------------------------------------------------------
SEQ ID NO: 112    ----------------------------------------------------------
SEQ ID NO: 114    ----------------------------------------------------------
SEQ ID NO: 116    ----------------------------------------------------------
SEQ ID NO: 82     ----------------------------------------------------------
SEQ ID NO: 110    ----------------------------------------------------------
SEQ ID NO: 118    ----------------------------------------------------------
SEQ ID NO: 106    ----------------------------------------------------------
SEQ ID NO: 132    ----------------------------------------------------------
SEQ ID NO: 120    ----------------------------------------------------------
SEQ ID NO: 18     ----------------------------------------------------------
SEQ ID NO: 22     ----------------------------------------------------------
SEQ ID NO: 30     ----------------------------------------------------------
SEQ ID NO: 44     ----------------------------------------------------------
SEQ ID NO: 36     ----------------------------------------------------------
SEQ ID NO: 74     ----------------------------------------------------------
SEQ ID NO: 20     ----------------------------------------------------------
SEQ ID NO: 68     ----------------------------------------------------------
SEQ ID NO: 46     ----------------------------------------------------------
SEQ ID NO: 54     ----------------------------------------------------------
SEQ ID NO: 48     ----------------------------------------------------------
SEQ ID NO: 56     ----------------------------------------------------------
SEQ ID NO: 38     ----------------------------------------------------------
SEQ ID NO: 40     ----------------------------------------------------------
SEQ ID NO: 70     ----------------------------------------------------------
SEQ ID NO: 76     ----------------------------------------------------------
SEQ ID NO: 26     ----------------------------------------------------------
SEQ ID NO: 32     ----------------------------------------------------------
SEQ ID NO: 28     ----------------------------------------------------------
SEQ ID NO: 62     ----------------------------------------------------------
SEQ ID NO: 64     ----------------------------------------------------------
SEQ ID NO: 60     ----------------------------------------------------------
SEQ ID NO: 58     ----------------------------------------------------------
SEQ ID NO: 50     ----------------------------------------------------------
```

FIGURE 2 B (continued)

```
SEQ ID NO: 6    ------------------------------------------------------------
SEQ ID NO: 14   ------------------------------------------------------------
SEQ ID NO: 138  ------------------------------------------------------------
SEQ ID NO: 128  ------------------------------------------------------------
SEQ ID NO: 130  ------------------------------------------------------------
SEQ ID NO: 124  ------------------------------------------------------------
SEQ ID NO: 8    ------------------------------------------------------------
SEQ ID NO: 10   ------------------------------------------------------------
SEQ ID NO: 12   ------------------------------------------------------------
SEQ ID NO: 134  ------------------------------------------------------------
SEQ ID NO: 136  ------------------------------------------------------------
SEQ ID NO: 66   ------------------------------------------------------------
SEQ ID NO: 126  ------------------------------------------------------------
SEQ ID NO: 42   ------------------------------------------------------------
SEQ ID NO: 52   ------------------------------------------------------------
SEQ ID NO: 96   -------------------------------------------------------IRDPDD
SEQ ID NO: 122  ------------------------------------------------------------
SEQ ID NO: 84   -----------------------------------------------------------H
SEQ ID NO: 86   -----------------------------------------------------------H
SEQ ID NO: 90   -------------------------------------------------------QHNQDD
SEQ ID NO: 98   ------------------------------------------------------------
SEQ ID NO: 92   ------------------------------------------------------------
SEQ ID NO: 88   -------------------------------------------------------RHNQDD
SEQ ID NO: 94   -------------------------------------------------------PNTPED
SEQ ID NO: 4    --------------------------------------------------------HSQDD
SEQ ID NO: 100  -----------------------------------------------------------D
SEQ ID NO: 104  -----------------------------------------------------------A
SEQ ID NO: 2    -----------------------------------------------------------H
SEQ ID NO: 72   GSHPDQTSDQMGGASGTMNQCIHPTLPVDPKFDGNAAAQPFPHNYAAFAPMMQCHCNQDA
SEQ ID NO: 102  ------------------------------------------------------------
SEQ ID NO: 16   ------------------------------------------------------------
SEQ ID NO: 24   ------------------------------------------------------------
SEQ ID NO: 78   ------------------------------------------------------------
SEQ ID NO: 108  ------------------------------------------------------------
SEQ ID NO: 80   ------------------------------------------------------------
SEQ ID NO: 34   ------------------------------------------------------------
SEQ ID NO: 112  ------------------------------------------------------------
SEQ ID NO: 114  ------------------------------------------------------------
SEQ ID NO: 116  ------------------------------------------------------------
SEQ ID NO: 82   ------------------------------------------------------------
SEQ ID NO: 110  ------------------------------------------------------------
SEQ ID NO: 118  ------------------------------------------------------------
SEQ ID NO: 106  ------------------------------------------------------------
SEQ ID NO: 132  ------------------------------------------------------------
SEQ ID NO: 120  ------------------------------------------------------------
SEQ ID NO: 18   ------------------------------------------------------------
SEQ ID NO: 22   ------------------------------------------------------------
SEQ ID NO: 30   ------------------------------------------------------------
SEQ ID NO: 44   ------------------------------------------------------------
SEQ ID NO: 36   ------------------------------------------------------------
SEQ ID NO: 74   ------------------------------------------------------------
SEQ ID NO: 20   ------------------------------------------------------------
SEQ ID NO: 68   ------------------------------------------------------------
SEQ ID NO: 46   ------------------------------------------------------------
SEQ ID NO: 54   ------------------------------------------------------------
SEQ ID NO: 48   ------------------------------------------------------------
SEQ ID NO: 56   ------------------------------------------------------------
SEQ ID NO: 38   ------------------------------------------------------------
SEQ ID NO: 40   ------------------------------------------------------------
SEQ ID NO: 70   ------------------------------------------------------------
SEQ ID NO: 76   ------------------------------------------------------------
SEQ ID NO: 26   ------------------------------------------------------------
SEQ ID NO: 32   ------------------------------------------------------------
SEQ ID NO: 28   ------------------------------------------------------------
SEQ ID NO: 62   ------------------------------------------------------------
SEQ ID NO: 64   ------------------------------------------------------------
SEQ ID NO: 60   ------------------------------------------------------------
SEQ ID NO: 58   ------------------------------------------------------------
SEQ ID NO: 50   ------------------------------------------------------------
```

FIGURE 2 B (continued)

```
SEQ ID NO: 6     ------------------------------SSRTLSDSKGLRLAKQAPSMHGLPD---F
SEQ ID NO: 14    ------------------------------SSRTVSGSEIVRKAKQPPVLHGVPD---F
SEQ ID NO: 138   ------------------------------STRTLLTSEIPKQGKQAPVLHGLPD---F
SEQ ID NO: 128   ------------------------------------------------------------
SEQ ID NO: 130   ------------------------------SPRAQLVGESNGQRNNSHPLRVLP-----
SEQ ID NO: 124   ------------------------------TPKAQPVGGTTDQVNHSHALRVLPD---F
SEQ ID NO: 8     ------------------------------TPRPRSNRDARDHGNVGHSLRVLPD---F
SEQ ID NO: 10    -------------------------SRDKQRTR--IVTETNDQESCGKPHRVAPN---F
SEQ ID NO: 12    -------------------------QEDTERVR--AVTKPNNEESCEKPHRVMPN---F
SEQ ID NO: 134   ------------------------------SSSNESTPPTWPSSKRTNQGDQEPIKVMPD---F
SEQ ID NO: 136   ------------------------------------------------------------
SEQ ID NO: 66    ------------------------------ESPSTTWPTSEAVEQENMLRPLRAMPD---F
SEQ ID NO: 126   ------------------------------EGPPRAWQSGETNDQINQVPSLRIMPD---F
SEQ ID NO: 42    ------------------------TSMDWTGTTSEMATASIVQDETIELPLSPDDLQF
SEQ ID NO: 52    ------------------------WIG-----DDAFFMQDETIRLPISPDDLGF
SEQ ID NO: 96    YRSFFQLSSTFSSLIVSALLQNPAAHVAASFAASFWPYANMERPTDSPTDNT----ASQI
SEQ ID NO: 122   ------------------------------------------------------------
SEQ ID NO: 84    PFSWPHIPPAFSTHLTSALVQNPAAHAAANLAASYWLSADVEAASSVDS-------ASSA
SEQ ID NO: 86    PFSWPHVPPAFSSHLTSALLQNPAAHAAANMAASFWLTADVETSSSVDSGNA----ASSS
SEQ ID NO: 90    YQSFLHMSSTFSNLVVSTLLQNPAAHVAASFAATFWPYANPETSADSPRCSQGGFTSRQI
SEQ ID NO: 98    ------------------------------------------------------------
SEQ ID NO: 92    ------------------------------------------------------------
SEQ ID NO: 88    YQSFLHMSSTFSSLIVSTLMQNPAAHAAASFAATVWPYANVEASADSPASTQGVFPPRQM
SEQ ID NO: 94    YSSFVQMSATFSSLIVSALLQNPAAHAAASFAASFWPCSNMENSANCPAGLSGGFPPRPM
SEQ ID NO: 4     YRSFLQISSTFSNLIMSTLLQNPAAHAAATFAASVWPYASVGNSGDSSTPMS--------
SEQ ID NO: 100   FSAFFNLSAQFSNLVISTLLQNPAAHAAATLAASFWPAAGMKTSTGTTPDNQ-------T
SEQ ID NO: 104   FPPFFNMSAEFSSLVVSTLLQNPAAYATAMLAASFWPPADVDTSSDPGSDGR-------I
SEQ ID NO: 2     PHPVAGDYQSFPNHIMSTLLQTPALYTAATFASSFWPPDSSGGSP------------VPG
SEQ ID NO: 72    YRSFANMSSTFSSMLVSTLLSNPAIHAAARLAASYWPTVDGNTPDPNQENLSESAQGSHA
SEQ ID NO: 102   ------------------------------------------------------------
SEQ ID NO: 16    -------------------------KKNNYTTSKQPFKDDSDIGSTPISS--------
SEQ ID NO: 24    -------------------------QNNYTTSKQPFKDDSDIGSTPISS--------
SEQ ID NO: 78    --------------------SSVDREDGCLSPSIPTAELAMQAPNTKMSIATTDAKEASSE
SEQ ID NO: 108   --------------------SSVDRGDGCLSPNTTKASEFTANGDVKEGSCTG------SA
SEQ ID NO: 80    --------------------SIATAELAMEIPPTNDEEVKGNGDHEEVTCDR------SG
SEQ ID NO: 34    --------------------SAEISSHTEESLSLEAETKQS-------------
SEQ ID NO: 112   ------------------------------------------------------------
SEQ ID NO: 114   ---------------------VEKENDCMTSKESEEEEKASP--------
SEQ ID NO: 116   ------------------------------------------------------------
SEQ ID NO: 82    ------------------IDPSQSHKEIDQDRKDVNNMSEEDSSEEEVQET--------
SEQ ID NO: 110   ------------------------SFTRAKPKTTTSEEEAGMDTDSTHD--------
SEQ ID NO: 118   ------------------------SFTRAEHKTTS--DEAGMDTDSAHD--------
SEQ ID NO: 106   ------------------------RFPIAEPKTSF--KEEGSAPSSAHD--------
SEQ ID NO: 132   ------------------------------------------------------------
SEQ ID NO: 120   ------------------------SAAIAAVLSVACDKMQNNLHQELRQG--------
SEQ ID NO: 18    ------------------QDPTQENSPLPETNISSGQQAMQVFTDVPTKTENAP-
SEQ ID NO: 22    ------------------VLIQENTSQSSSPVEEINNFSIHPVMQVFPEFPVPTGNQSY
SEQ ID NO: 30    -------------QEAIEPSN---GVSPMLVPGGFFPPCFPVTYTIWLPASLHGTEHALN
SEQ ID NO: 44    -------------HAAPFKTK---FVLTMPT---FYPALIPVPLTLWPPN-------VAN
SEQ ID NO: 36    -------------QSQLQPQPQLPGSFPILYP-TYFSPYYPFPFPIWPAG-------YVPE
SEQ ID NO: 74    -------------ASAIMPDN-LQSTYPVIVP-AYFSPFLQFSVPFWQNQ------KDED
SEQ ID NO: 20    ----------------LQTP------LELIRP-------VPIPIPIPPSR----------
SEQ ID NO: 68    -------GSNTTETGAAIPEVMPPYGYPMMLPPYYPPAFVPMPYYGYVPV------FYAP
SEQ ID NO: 46    ------------------LKLRHETASVPAEMGFPALSLGISSMAQPEA------MLLP
SEQ ID NO: 54    ------------------PISGSASELQIPGMSIGVG--VVKEE------VVLP
SEQ ID NO: 48    ------------------SEQLSGEGAAAAAAASTSLSLMNTHET------SSDR
SEQ ID NO: 56    ------------------SLASSDPATRCNNNISASLSLQVSHHK------SGD-
SEQ ID NO: 38    --------------------VEENSTTKRICNDHIGSSSKVVWKQ------GLLN
SEQ ID NO: 40    -------------DASTKTPPKQPITGIQQPVVQGHTQTEISNRFQNLS-----MEYMP
SEQ ID NO: 70    -------MVAMTKQLQNSSLEGVSSSSTVNLAPQVARDLPPPIPSFKATNVDSSLSKMNH
SEQ ID NO: 76    ------------------------------SPQSVGTKPPTQDIIHTDRGD-
SEQ ID NO: 26    --------------------NLNSMGQQPHFDDQSPPDHYQDYFSQSNVTIPGCNMHF
SEQ ID NO: 32    ------------------------NLESTGQQPHF-------------------
SEQ ID NO: 28    ------------------------STEGNPDS---------------
SEQ ID NO: 62    ---------------------NNNLGGGQLIIAVVGAVGIIGPGAGHIAP----------
SEQ ID NO: 64    -------------GAVEHHENYNNNNLGGGQLNAGLGAVGHGPGAGHIAP----------
SEQ ID NO: 60    --------------------YSNNNFGGWQSLAFAGGHLEPVSGGGAAR----------
SEQ ID NO: 58    ---------------------------------QQAAAAEHAA----------
SEQ ID NO: 50    ---------------------------------PTTTTSAP----------
```

FIGURE 2 B (continued)

```
SEQ ID NO: 6     AEVYNFIGSVFDPDSK------------------------------------------
SEQ ID NO: 14    AEVYNFIGSVFDPETR------------------------------------------
SEQ ID NO: 138   AEVYGFIGSVFDPETN------------------------------------------
SEQ ID NO: 128   ----------------------------------------------------------
SEQ ID NO: 130   ----------------------------------------------------------
SEQ ID NO: 124   TQVYGFIGSVFDPNVT------------------------------------------
SEQ ID NO: 8     AQVYGFIGSVFDPYAS------------------------------------------
SEQ ID NO: 10    AEVYNFIGSVFDPKTT------------------------------------------
SEQ ID NO: 12    AEVYSFIGSVFDPNTS------------------------------------------
SEQ ID NO: 134   AQVYSFIGSVFDPNST------------------------------------------
SEQ ID NO: 136   ----------------------------------------------------------
SEQ ID NO: 66    AQVYSFLGSIFDPDTS------------------------------------------
SEQ ID NO: 126   AQVYSFLGSVFDPSTK------------------------------------------
SEQ ID NO: 42    AQVYRFIGDIFDPDSPCP----------------------------------------
SEQ ID NO: 52    AQVYKFVGDMFGSGERRP----------------------------------------
SEQ ID NO: 96    NSAPSMAAIAAATVAAATAWWAAHGLLPLCS-QFQSSFTCVPTSATSMQVDACQPR--VD
SEQ ID NO: 122   ----------------------------------------------------------
SEQ ID NO: 84    S--PTMAAAAAATVAAASAWWATQGLLPFCYPSFNGCFAAFAPPPTP-ITLTESTG--VK
SEQ ID NO: 86    S--PSVAAAAIATVAAASAWWATHGLLPFCYPSFNGCFAAVPPPPTTTPTLTEATR--VK
SEQ ID NO: 90    GSPPSVAAIAAATVAAATAWWAAHGLLPLCLPLHAAFACPPASVTAVP------------
SEQ ID NO: 98    ----------------------------------------------------------
SEQ ID NO: 92    ----------------------------------------------------------
SEQ ID NO: 88    GSTPSMAAIAAATVAAATAWWAAHGLVPLCAPLPTAFTCNPASTAAVPPTDSGQAPAAKT
SEQ ID NO: 94    NTAPSMAAIAGATVAAATAWWAAHGLLPLCAPVHSGFNCPPAS-ANAPLTNVAQSQATNK
SEQ ID NO: 4     SSPPSITAIAAATVAAATAWWASHGLLPVCAPAP--ITCVPFSTVAVPTP----------
SEQ ID NO: 100   NPTPSMEAIVAATVAAASAWWAAHGLLPLCPLAGLFPGISAFS-----------------
SEQ ID NO: 104   NPTPSIAAIAAATVAAASAWWAMHGLLPFCPPAGLFPGVFPLA-----------------
SEQ ID NO: 2     NSPPNLAAMAAATVAAASAWWAANGLLPLCAPLSSGGFTSHPSTFGPS-----------
SEQ ID NO: 72    GSPPNMASIVTATVAAASAWWATQGLLPLFPPPIAFPFVPAFSAPFSTADVQR-------
SEQ ID NO: 102   ----------------------------------------------------------
SEQ ID NO: 16    ---ITLFGKIVLVAEESH----------------------------------------
SEQ ID NO: 24    ---ITLFGKIVLVAEESH----------------------------------------
SEQ ID NO: 78    ASVFRLFGKSVVVKDSDQ----------------------------------------
SEQ ID NO: 108   TSVLKLFGKKVVVNDSFQKPNTST----------------------------------
SEQ ID NO: 80    VPVLRLFGKRVMVNDLHQMSAPDA----------------------------------
SEQ ID NO: 34    ---LKLFGKTFVVGDYNS----------------------------------------
SEQ ID NO: 112   ----------------------------------------------------------
SEQ ID NO: 114   --ASRPLSTVSNPKMCMK----------------------------------------
SEQ ID NO: 116   ----------------------------------------------------------
SEQ ID NO: 82    --SLKLFGRTVVIPDPRK----------------------------------------
SEQ ID NO: 110   --EKPLMKFKLPPNGCVS----------------------------------------
SEQ ID NO: 118   --EKPLMKFKLPPNECVS----------------------------------------
SEQ ID NO: 106   --EQPPVKLEFLHKESVS----------------------------------------
SEQ ID NO: 132   ----------------------------------------------------------
SEQ ID NO: 120   -----YFGIPTGMQ--------------------------------------------
SEQ ID NO: 18    -ETFHLNDPYLVPVTFQAKPT-------------------------------------
SEQ ID NO: 22    GQLTSSNLINLVPLTFQSSP--------------------------------------
SEQ ID NO: 30    AETSSQQHQVLKPKPGFAKE---RVN--------------------------------
SEQ ID NO: 44    VGESGTNHEILKPTPVNGKE---VINK-------------------------------
SEQ ID NO: 36    PPKKEETHEILRPTAVHSKA---PIN--------------------------------
SEQ ID NO: 74    GP-VQETHEIVKPVPVHSKS---PIN--------------------------------
SEQ ID NO: 20    --------KMADLNLNKKKT---PAT--------------------------------
SEQ ID NO: 68    PGAVQAQHEVVKPVAVHSKP---PVH--------------------------------
SEQ ID NO: 46    PPSLTLTPSCSSPAVSSSSSEQP-----------------------------------
SEQ ID NO: 54    P-CLNLMSNSSSASQHSPSLT-------------------------------------
SEQ ID NO: 48    VAAIDLNSTEEDDTVGASGRPF------------------------------------
SEQ ID NO: 56    ------SAWPSSETPSVS----------------------------------------
SEQ ID NO: 38    P-----RLGYPDPKVSVSG---------------------------------------
SEQ ID NO: 40    IYQPIPPYYNFPPIMYHPNYPMYYANP-------------------------------
SEQ ID NO: 70    MDGFLRAPMLFRPIPRIAEGASSSTPA-------------------------------
SEQ ID NO: 76    ------VPILSYPVARGFRGDSVQVDE-------------------------------
SEQ ID NO: 26    MGQQPRFGDQIPPGEYHPYSRD------------------------------------
SEQ ID NO: 32    -------GDQIPSNQYYPS---------------------------------------
SEQ ID NO: 28    -------GNQNPPDDDDPS---------------------------------------
SEQ ID NO: 62    ---ATPSNNNTAAAAVNNN---------------------------------------
SEQ ID NO: 64    ---ATSSNNNVAAAAANNN---------------------------------------
SEQ ID NO: 60    ---QVIAPASSSAAAMNS----------------------------------------
SEQ ID NO: 58    ---ALRRRMPVPPPPFNPF---------------------------------------
SEQ ID NO: 50    ---ESAGAGPSAPP--------------------------------------------
```

FIGURE 2 B (continued)

```
SEQ ID NO: 6     ------------------------GRMKKLKEMDPINFETVLLLMRNLTVNLSNPDFE
SEQ ID NO: 14    ------------------------GHVEKLKEMDPINFETVLLLMRNLTVNLSNPDLE
SEQ ID NO: 138   ------------------------DHVQKLKEMDPINFETVLLLMRNLTVNLSSPDFE
SEQ ID NO: 128   ------------------------------------------------------
SEQ ID NO: 130   ------------------------------------------------------
SEQ ID NO: 124   ------------------------GHLQNLKKMDPIDVETVLLLMRNLSMNLTNPEFE
SEQ ID NO: 8     ------------------------NHLQKLKKMDPIDVETVLLLMRNLSINLSSPDFE
SEQ ID NO: 10    ------------------------GHVKRLKEMDPTNLETVLLLMKNLSVNLTSPEFD
SEQ ID NO: 12    ------------------------GHLQRLKQMDPINMETVLLLMQNLSVNLTSPEFA
SEQ ID NO: 134   ------------------------NHLQKLRQMDPLNVETILLLMRNLSINLMSPEFE
SEQ ID NO: 136   ------------------------------------------------------
SEQ ID NO: 66    ------------------------GHLQTLKAMDPIDVETVLLLMRNLSMNLTSPNFA
SEQ ID NO: 126   ------------------------GHLQKLKEMNPIDVETALLLMRNLSINLTSPDFE
SEQ ID NO: 42    ---------------------VETHLQKLKSMDDIIVKTILLVLRNLEDNLLSPQFE
SEQ ID NO: 52    ---------------------VEAHLRRLQGMDPAISETILLVLKNLEANLSA----
SEQ ID NO: 96    KNEGREGTHDSPHVQEPVPECSEALQEQQSGSKLPPSLSSESEESEGRKLKTGLTATDT-
SEQ ID NO: 122   ------------------------------------------------------
SEQ ID NO: 84    VNP-NVEEQEE---QGR-----------SKGSPLSSTDSNPSEKREVNGEGEVKVQGQS-
SEQ ID NO: 86    VNPRNGKEEEE---KDLRQGFDPGTSLTAKGSPLSSTDSNPSEKREVNGEGEVNVHGQP-
SEQ ID NO: 90    ------SMNPF--VQDQKHPEYSEAPQAQHSDSKSLAVISSDSET-GNAKLNTSPKATDH-
SEQ ID NO: 98    ------------------------------------------------------
SEQ ID NO: 92    ------------------------------------------------------
SEQ ID NO: 88    EGEVNTLQTF--PLQQLDPEYSEAVQAQHSDSKLPIPSSSDSEESGGAKLNSGPKATDH-
SEQ ID NO: 94    EREENNFQNFGSQVQQPDQELSEALQPQHSASKPSATSSSDSGDSAGAKMEIEIPTNDN-
SEQ ID NO: 4     -----AMTEMDTVFNTQPFEKQNTALQDQNLASKSPASSSDDSDETGVTKLNADSKTNDDK
SEQ ID NO: 100   --------------------PGPKVEEAANPRSKSMPSSSDSDELNPTKQVSCSKPDES-
SEQ ID NO: 104   --------------------PSLTVEEAGQ-RSKSIPSSSESDERNPANETNR-EPDEP-
SEQ ID NO: 2     ----CDVEYTKASTLQHGSVQSREQEHSEASKARSSLDSEDVENKSKPVCHEQPSATPE-
SEQ ID NO: 72    ---AQEKDIDCPMDNAQKELQETRKQDNFEAMKVIVSSETDESGKGEVSLHTELKISPAD
SEQ ID NO: 102   ------------------------------------------------------
SEQ ID NO: 16    ------------------------KPSSYNDDDLKQMTCQENHYSGMLVDTN-----
SEQ ID NO: 24    ------------------------KPSSYNDDDLKQMTCQENHYSGMLVDTN-----
SEQ ID NO: 78    --------------------LHLLNGSNIATSGSVERATRNILVPSFAAAPEGSSSNPWP
SEQ ID NO: 108   --------------------GNPQNGGDVGTEASDDTTTQGSRNLPSGGATEGSSWNPWP
SEQ ID NO: 80    --------------------GNLQTVADMEVDASAETPTSGTGKFSSHGAAEEANTWNPWL
SEQ ID NO: 34    ------------------------SMSCDDSEDGKKK-------------------
SEQ ID NO: 112   ------------------------------------------------------
SEQ ID NO: 114   ----------------------PEFSSKEIEDATDMPQTTSIKLFGRTVSMVGNQKS--
SEQ ID NO: 116   ------------------------------------------------------
SEQ ID NO: 82    ----------------------RSSSDPKHESEEQISQPSNEEMLQASSSVGEIPAAYC
SEQ ID NO: 110   ---------------------------IKEDNTAEESSGRTFKLFGMTLFVTDTCKPS-
SEQ ID NO: 118   ---------------------------IKDD-TAEESSGRTFKLFGMTLFVTDTCKPS-
SEQ ID NO: 106   ---------------------------TRDD-ATEESSGRTLKLFGTTLLVTDTCKPSS
SEQ ID NO: 132   ------------------------------------------------------
SEQ ID NO: 120   ------------------------PQQGMFAQPGMFPMNAMMSPFVAMNTVSGAPTP
SEQ ID NO: 18    ------------------------FNLNTDAAPLSLNLCLASSFNLNEQPNSRHSAFT
SEQ ID NO: 22    ---------------------------APLSLNLSLASS-NLNEPSPS------
SEQ ID NO: 30    ----------------MDELVGMSQLSIGMATRHETETSPSPL-SLR-LEPSRPSAFH
SEQ ID NO: 44    ----------------ADEVVGMSKLTIGDGSSNSIEPSALSL-QLTGPTNTRQSAFH
SEQ ID NO: 36    ----------------VDELLCGMSKLSLAESNKHCESDQSLSL-KLCCCSSSRQSAFH
SEQ ID NO: 74    ----------------VDELVGMSKLSIGESNQETVS-TSLSL-NLVGGQN-RQSAFH
SEQ ID NO: 20    ----------------TEMFPLSLN-LQRPSSSTSSSSN-EQKARGSRASSGFE
SEQ ID NO: 68    ----------------IDELYSMSELSLKGEAGVKNGTPNSLLPPRPIGRPDRQSAFH
SEQ ID NO: 46    ----------------RTIHPSLMVAKPQVQLQLQPPDLELKISTVRQNDQPSSSP
SEQ ID NO: 54    ---------------LLANPQVQLQM--PDLELKMSTSRLSDQSGPSP
SEQ ID NO: 48    ----------------FPVVLMEQQQQASHGHGHHHHCTPLDELGMSVS
SEQ ID NO: 56    -----------------EAQQGHGYGTSHHCSPLDELGMSLS
SEQ ID NO: 38    ---------------------SGNSGGLDLELKLASIQSPESNIRPI
SEQ ID NO: 40    ----------------QVPVRFVHPSGIPVPRHIPIGLPLSQPSEASNMTNKDGLDLH
SEQ ID NO: 70    ----------------TASIADLEFQANLTACSNALFASPRRKPKKADPPAEKDLDLT
SEQ ID NO: 76    ----------------LT-----EYVKRLKAAEDMSLSMISG--LEMASSSISSLELS
SEQ ID NO: 26    ----------------NVTVTGSNLNSIGQQPHFNDQISPDQYGRYLQENFGFFD
SEQ ID NO: 32    -----------------------------------QENFRGFD
SEQ ID NO: 28    -----------------------------------------QGQGTCLG
SEQ ID NO: 62    ------------------------VDTPFWVPLLYNPEIEQRMMEMQAQSQKAWDDQQMK
SEQ ID NO: 64    ------------------------VDAPFWVPLLYNLEIEQRMMEMQAQSQKAWDDQQMK
SEQ ID NO: 60    ------------------------AAQFWAPMLFNPQIQQQFMQMQAQTQQAWNDQHMM
SEQ ID NO: 58    ------------------------LLPSLVAPVMHRLLPPGSQAAGAAASGSGGQGASLP
SEQ ID NO: 50    --------------------------------------CALIESGALIAGDDDA--
```

FIGURE 2 B (continued)

```
SEQ ID NO: 6      PTSEYVDAAEEGHEHLSS----------------------------------------
SEQ ID NO: 14     STSDCNDAAEESPLII------------------------------------------
SEQ ID NO: 138    PI--------------------------------------------------------
SEQ ID NO: 128    ----------------------------------------------------------
SEQ ID NO: 130    ----------------------------------------------------------
SEQ ID NO: 124    DHRQLLSSYKMDANTGNLS-DATKTLCDDQHEKVP------------------------
SEQ ID NO: 8      DHRRLLSSYDIGSETATDHGGVNKTLNKDPPEIST------------------------
SEQ ID NO: 10     EQRKLISSYNAS----------------------------------------------
SEQ ID NO: 12     EQRRLISSYSAKALK-------------------------------------------
SEQ ID NO: 134    DHKRLLSSYDTDSDKSKLVNICSKSLTNKSESAVLSA----------------------
SEQ ID NO: 136    ----------------------------------------------------------
SEQ ID NO: 66     AHLSLLSSCNSGGDPIKSEGMENLGSPQSCHLPFMVTSE--------------------
SEQ ID NO: 126    DQRKLLSSYNS-----TSDGLE-LGSSRSSLLTDNALSLF-------------------
SEQ ID NO: 42     PIRRLLSTYDPNRGLSGHL---------------------------------------
SEQ ID NO: 52     ----------------------------------------------------------
SEQ ID NO: 96     -EQGAAVTKINEFNAEKGGKQVDRSSCGSNTPSSS-EIETDALEKDEKGKEEPQESNINL
SEQ ID NO: 122    ----------------------------------------------------------
SEQ ID NO: 84     -LTQR-----EEKSTLEGKNQLDRSSSGSNTPGS--EVENEGVEPTEDEMPKEE--AVDP
SEQ ID NO: 86     -QNQQKSTPDEESFRRKGKNQLDRSSSGSNTPGS--EVDNDGAGPTEEEKPKDDDLSVDP
SEQ ID NO: 90     VTNE-TISEHLDSDKTKGRKQVDRSSCGSNTASSS-DVETDALGKDEKGKEEPETPDANN
SEQ ID NO: 98     ----------------------------------------------------------
SEQ ID NO: 92     ----------------------------------------------------------
SEQ ID NO: 88     ENAV-TATETELHDSNKTKGRKQVDRSSCGSNTASSS-DRETDALEKQEMGKEEPKEPDANH
SEQ ID NO: 94     EIKVPAMTEQKDSSKGKSKKLVDRSSCGSNTPSGS-DVETDALQKNDKGKEEPLEPDISQ
SEQ ID NO: 4      IEEVVVTAAVHDSNTAQKKNLVDRSSCGSNTPSGS-DAETDALDKMEKDKEDVKETDENQ
SEQ ID NO: 100    ---------------GREKKKADRSSCGSNTPSSS-DVETDVVLDLE--KEDLHLGLAYS
SEQ ID NO: 104    ---------------RGEKKKADRSSCGSNTPSSS-DMETNAVLDLE--KEDLHLGPAHS
SEQ ID NO: 2      -------SDAKGSDGAGDRKQVDRSSCGSNTPSSSDDVEADASERQEDGTNGEVKETNED
SEQ ID NO: 72     KADTKPAAGAETSDVFGNKKKQDRSSCGSNTPSSSDIEADNAPENQEKANDKAKQASCSN
SEQ ID NO: 102    ----------------------------------------------------------
SEQ ID NO: 16     LSLGVWETFCTGSNAFG----------------------SVTEASENLEKSAEPISSS
SEQ ID NO: 24     LSLGVWETFCTGSNAFG----------------------SVTEASENLEKSAEPISSS
SEQ ID NO: 78     SSMQQFLYFLPRSDGFAAQPVMPWLSYN-GSLPCALFY-PAAAAAANQQCHRDSEGVEFR
SEQ ID NO: 108    SSMQQFVYFVPQFDGFATQSAVPWF----GTLPGAMFY-QQAMAPNQHQRHR-SETADHK
SEQ ID NO: 80     TNTQQFLYYLPNGQIFSVHSALPCFTYHNEGVTCTQFSNPQVVASDQQHQHQTSEAVDYK
SEQ ID NO: 34     ------LYSETQS-------------------------LQCSSSTSEDAETEVVVSEFK
SEQ ID NO: 112    ----------------------------------------------------------
SEQ ID NO: 114    ----------------------------------------------------------
SEQ ID NO: 116    ----------------------------------------------------------
SEQ ID NO: 82     APNGWFMSYNSFPFQFGESAADARIPPLHVWWPYYGFAPISHPRGLSTVMQQTEGSDESD
SEQ ID NO: 110    PTIEEC----------------------------------------------------
SEQ ID NO: 118    PTIEACKP-----------------------------------IPLNIRVR-------
SEQ ID NO: 106    PTTEPCKPTPAAAMYLMQLQNGCSDVTEGHASIVPWWTLPHNTPFMPLHKEPKGKHLYSN
SEQ ID NO: 132    ----------------------------------------------------------
SEQ ID NO: 120    PPMTNPQQFLNYANFFSNYWPQFANAANANAVNVMFQQQQQCQQQQQQQQHKQRAGGETK
SEQ ID NO: 18     MMPSFSDGDSNSSIIRVA----------------------------------------
SEQ ID NO: 22     MHPAFN-------TIGVA----------------------------------------
SEQ ID NO: 30     SNGSVNGADLSK-GNSAIQAI-------------------------------------
SEQ ID NO: 44     VNPPMAGPDLNKRNNSPIHAV-------------------------------------
SEQ ID NO: 36     PNPSSDSSDIKS----VIHAL-------------------------------------
SEQ ID NO: 74     ANPPTRAQA-------------------------------------------------
SEQ ID NO: 20     AMSSNGDSIMGVA---------------------------------------------
SEQ ID NO: 68     GKGPSDGSSNGLIPAK------------------------------------------
SEQ ID NO: 46     RTPFLGTIRVT-----------------------------------------------
SEQ ID NO: 54     STPFFGTIRVT-----------------------------------------------
SEQ ID NO: 48     STPSIGT---------------------------------------------------
SEQ ID NO: 56     TTPSIGT---------------------------------------------------
SEQ ID NO: 38     SVT-------------------------------------------------------
SEQ ID NO: 40     IGLPPQATGASDLTGHGVIHVK------------------------------------
SEQ ID NO: 70     VAPPSQQTRASISSQNAVGVIQVV----------------------------------
SEQ ID NO: 76     IAPPHCAIEAAIKVL-------------------------------------------
SEQ ID NO: 26     DDGEDDGSLASFCQLYKA----------------------------------------
SEQ ID NO: 32     QRW-------------------------------------------------------
SEQ ID NO: 28     V---------------------------------------------------------
SEQ ID NO: 62     MAEAATP---------------KEEG-----AADK-----------------------
SEQ ID NO: 64     MAEAATD---------------PKEG-----AADK-----------------------
SEQ ID NO: 60     MAAAPMEGATDTNFEPAGAVNYYYYQQQEEEEGGAYGVPADQWMMNQNNNMC-------
SEQ ID NO: 58     QMPWING----------------------ANG------MGR-----------------
SEQ ID NO: 50     ----------------------------------------------------------
```

FIGURE 2 B (continued)

```
SEQ ID NO: 6     ------------------------------------------------------------
SEQ ID NO: 14    ------------------------------------------------------------
SEQ ID NO: 138   ------------------------------------------------------------
SEQ ID NO: 128   ------------------------------------------------------------
SEQ ID NO: 130   ------------------------------------------------------------
SEQ ID NO: 124   ------------------------------------------------------------
SEQ ID NO: 8     ------------------------------------------------------------
SEQ ID NO: 10    ------------------------------------------------------------
SEQ ID NO: 12    ------------------------------------------------------------
SEQ ID NO: 134   ------------------------------------------------------------
SEQ ID NO: 136   ------------------------------------------------------------
SEQ ID NO: 66    ------------------------------------------------------------
SEQ ID NO: 126   ------------------------------------------------------------
SEQ ID NO: 42    ------------------------------------------------------------
SEQ ID NO: 52    ------------------------------------------------------------
SEQ ID NO: 96    LAGEAANRRYRNFISPT-------ESWKEVSEEGRIAFQALFTREVLPQSFSPSLDLKNK
SEQ ID NO: 122   ------------------------------------------------------------
SEQ ID NO: 84    TRRGVDPR-----------------KEVSKEGRLAFQALFSREVLPQSFSP-TETEDQ
SEQ ID NO: 86    NRRGVDPR-----------------KEVSKEGRLAFQALFSRGVLPQSFSP-TEGEAE
SEQ ID NO: 90    -LAIEFSNRRRSIYN-------LTDSWKEVSSEGRLAFQALFSREVLPQSFSPPHALKNK
SEQ ID NO: 98    ------------------------------------------------------------
SEQ ID NO: 92    ------------------------------------------------------------
SEQ ID NO: 88    -SAADTSNRRCCSSSSRSFS-YMNDSWKSVSEEGRLAFQALFSREVLPQSFSPPHDLKNM
SEQ ID NO: 94    -IAGELNNRRNRIASNN-----LNDSWKEVSEEGRLAFQALFSRERLPQSFSPPQDVSIM
SEQ ID NO: 4     PDVIELNNRKIKMRDNNSNNNATTDSWKEVSEEGRIAFQALFARERLPQSFSPPQVAENV
SEQ ID NO: 100   -----------------------ASWKEVSHQGREAFQALFNREVLPQSFSPPKEEEGR
SEQ ID NO: 104   -----------------------PSWKEVSHQGRKAFQALFSREVLPQSFSPPKEEEGR
SEQ ID NO: 2     TNKPQTSESNARRSRISSN---ITDPWKSVSDEGRIAFQALFSREVLPQSFTYREEHREE
SEQ ID NO: 72    SSAGDNNHRRFRSSASTS------DSWKEVSEEGRLAFDALFSRERLPQSFSPPQVEGSK
SEQ ID NO: 102   ------------------------------------------------------------
SEQ ID NO: 16    WKR----------------------LSSLEKQGSCNPVN---------------------
SEQ ID NO: 24    WKR----------------------LSSLEKQGSCNPVN---------------------
SEQ ID NO: 78    VSQREGSLTGSNTASSVVLGSSAAVPAAAAAAQNSDVAESRGQGNSREAAAS--PRLTKC
SEQ ID NO: 108   FMQREGSWTGSNTGP-------------GSAAHNSDAADSRGRGNSSESDKTPVPRLTKC
SEQ ID NO: 80    GIQREGSWTESNTSSS---------SVPETATHNSETTESYRNGNRNEDEMVPSPDSRKC
SEQ ID NO: 34    RSERS---------------------AFSQLKSSVTEMNN--------------------
SEQ ID NO: 112   ------------------------------------------------------------
SEQ ID NO: 114   ------------------------------------------------------------
SEQ ID NO: 116   ------------------------------------------------------------
SEQ ID NO: 82    GVKSHSSESSSDSGENVQ----------MTAPQSSRIVESLGAIYVRDSGSSF-------
SEQ ID NO: 110   ------------------------------------------------------------
SEQ ID NO: 118   -----------------CLSS--------SMGDDGKLELRGHSTASETSAISK------L
SEQ ID NO: 106   LGEFEHKEVQKEGSWTGSNTS--------SIDDGDNTEKSGDQAKSHVHGFSKSETLTIS
SEQ ID NO: 132   ------------------------------------------------------------
SEQ ID NO: 120   ------------------------------------------------------------
SEQ ID NO: 18    ------------------------------------------------------------
SEQ ID NO: 22    ------------------------------------------------------------
SEQ ID NO: 30    ------------------------------------------------------------
SEQ ID NO: 44    ------------------------------------------------------------
SEQ ID NO: 36    ------------------------------------------------------------
SEQ ID NO: 74    ------------------------------------------------------------
SEQ ID NO: 20    ------------------------------------------------------------
SEQ ID NO: 68    ------------------------------------------------------------
SEQ ID NO: 46    ------------------------------------------------------------
SEQ ID NO: 54    ------------------------------------------------------------
SEQ ID NO: 48    ------------------------------------------------------------
SEQ ID NO: 56    ------------------------------------------------------------
SEQ ID NO: 38    ------------------------------------------------------------
SEQ ID NO: 40    ------------------------------------------------------------
SEQ ID NO: 70    ------------------------------------------------------------
SEQ ID NO: 76    ------------------------------------------------------------
SEQ ID NO: 26    ------------------------------------------------------------
SEQ ID NO: 32    ------------------------------------------------------------
SEQ ID NO: 28    ------------------------------------------------------------
SEQ ID NO: 62    ------------------------------------------------------------
SEQ ID NO: 64    ------------------------------------------------------------
SEQ ID NO: 60    ------------------------------------------------------------
SEQ ID NO: 58    ------------------------------------------------------------
SEQ ID NO: 50    ------------------------------------------------------------
```

FIGURE 2 B (continued)

```
SEQ ID NO: 6    ------------------------------------------------------------
SEQ ID NO: 14   ------------------------------------------------------------
SEQ ID NO: 138  ------------------------------------------------------------
SEQ ID NO: 128  ------------------------------------------------------------
SEQ ID NO: 130  ------------------------------------------------------------
SEQ ID NO: 124  ------------------------------------------------------------
SEQ ID NO: 8    ------------------------------------------------------------
SEQ ID NO: 10   ------------------------------------------------------------
SEQ ID NO: 12   ------------------------------------------------------------
SEQ ID NO: 134  ------------------------------------------------------------
SEQ ID NO: 136  ------------------------------------------------------------
SEQ ID NO: 66   ------------------------------------------------------------
SEQ ID NO: 126  ------------------------------------------------------------
SEQ ID NO: 42   ------------------------------------------------------------
SEQ ID NO: 52   ------------------------------------------------------------
SEQ ID NO: 96   GKIILEKLKQKPDEKVQCGPQLDLNDMASNICSSHQTMEDNVLLIGNKEDVETCLPMIEL
SEQ ID NO: 122  ------------------------------------------------------------
SEQ ID NO: 84   KE------QKSTEVNPH--PEVNPVDRIP----------------------------AEL
SEQ ID NO: 86   KDEVLAPASAPSEVNALQPPQVNSVDQTS----------------------------VDI
SEQ ID NO: 90   -DQMDI-TNDYKQNIADRNE-----DLDSKKCSSNALHK-IPSFV----ENN--VGLLTI
SEQ ID NO: 98   ------------------------------------------------------------
SEQ ID NO: 92   ------------------------------------------------------------
SEQ ID NO: 88   GNQKDN-TTDDKQNANENDGNASLLDLNSQKSGSCSVQQGILNFE----PNNNGEGLLTI
SEQ ID NO: 94   DQVMNNGVERNGQNATETNEDASQLDLNSNTWRSCSGDQGHLENTGLREKENGKDHFLSI
SEQ ID NO: 4    NRKQSDTSMPLAPN-------------FKSQDSCAADQ---------------EGVVMI
SEQ ID NO: 100  ------------------------------------------------------------
SEQ ID NO: 104  ------------------------------------------------------------
SEQ ID NO: 2    EQQQQEQRYPMALDLNFTAQLTPVDDQEEKRNTG-----------------------FLGI
SEQ ID NO: 72   EISKEEEDEVTTVTVDLNKNAAIIDQELDTADEPRASFP---------------------
SEQ ID NO: 102  ------------------------------------------------------------
SEQ ID NO: 16   ------------------------------------------------------------
SEQ ID NO: 24   ------------------------------------------------------------
SEQ ID NO: 78   ESSASV------------------------------------------------------
SEQ ID NO: 108  ESSVSV------------------------------------------------------
SEQ ID NO: 80   VSPGSN------------------------------------------------------
SEQ ID NO: 34   ------------------------------------------------------------
SEQ ID NO: 112  ------------------------------------------------------------
SEQ ID NO: 114  ------------------------------------------------------------
SEQ ID NO: 116  ------------------------------------------------------------
SEQ ID NO: 82   ---ELK------------------------------------------------------
SEQ ID NO: 110  ------------------------------------------------------------
SEQ ID NO: 118  KVRVGP------------------------------------------------------
SEQ ID NO: 106  ELRVRP------------------------------------------------------
SEQ ID NO: 132  ------------------------------------------------------------
SEQ ID NO: 120  ------------------------------------------------------------
SEQ ID NO: 18   ------------------------------------------------------------
SEQ ID NO: 22   ------------------------------------------------------------
SEQ ID NO: 30   ------------------------------------------------------------
SEQ ID NO: 44   ------------------------------------------------------------
SEQ ID NO: 36   ------------------------------------------------------------
SEQ ID NO: 74   ------------------------------------------------------------
SEQ ID NO: 20   ------------------------------------------------------------
SEQ ID NO: 68   ------------------------------------------------------------
SEQ ID NO: 46   ------------------------------------------------------------
SEQ ID NO: 54   ------------------------------------------------------------
SEQ ID NO: 48   ------------------------------------------------------------
SEQ ID NO: 56   ------------------------------------------------------------
SEQ ID NO: 38   ------------------------------------------------------------
SEQ ID NO: 40   ------------------------------------------------------------
SEQ ID NO: 70   ------------------------------------------------------------
SEQ ID NO: 76   ------------------------------------------------------------
SEQ ID NO: 26   ------------------------------------------------------------
SEQ ID NO: 32   ------------------------------------------------------------
SEQ ID NO: 28   ------------------------------------------------------------
SEQ ID NO: 62   ------------------------------------------------------------
SEQ ID NO: 64   ------------------------------------------------------------
SEQ ID NO: 60   ------------------------------------------------------------
SEQ ID NO: 58   ------------------------------------------------------------
SEQ ID NO: 50   ------------------------------------------------------------
```

FIGURE 2 B (continued)

```
SEQ ID NO: 6     ----------------------------------------------------------
SEQ ID NO: 14    ----------------------------------------------------------
SEQ ID NO: 138   ----------------------------------------------------------
SEQ ID NO: 128   ----------------------------------------------------------
SEQ ID NO: 130   ----------------------------------------------------------
SEQ ID NO: 124   ----------------------------------------------------------
SEQ ID NO: 8     ----------------------------------------------------------
SEQ ID NO: 10    ----------------------------------------------------------
SEQ ID NO: 12    ----------------------------------------------------------
SEQ ID NO: 134   ----------------------------------------------------------
SEQ ID NO: 136   ----------------------------------------------------------
SEQ ID NO: 66    ----------------------------------------------------------
SEQ ID NO: 126   ----------------------------------------------------------
SEQ ID NO: 42    ----------------------------------------------------------
SEQ ID NO: 52    ----------------------------------------------------------
SEQ ID NO: 96    GQVR---LKARRTGFKPYKRCSLEANDSRVTSSN--CQDEEKSSKRLRLEGEAST
SEQ ID NO: 122   ----------------------------------------------------------
SEQ ID NO: 84    SQHR---LKPHCTGFKPYKRCSVEAKQTEPPP------EEDKCSKRICLEREASI
SEQ ID NO: 86    GQLR---PKPHCIGFKPYKRCSVEAKETEPPP------EDDKCSKRMCLEREAST
SEQ ID NO: 90    GLGQGK-LKTRRTGFKPYKRCSVEARENRVG-----ANCEEKGCKRIRLEGDTST
SEQ ID NO: 98    ----------------------------------------------------------
SEQ ID NO: 92    ----------------------------------------------------------
SEQ ID NO: 88    GLAYGK-LKARRTGFKPYKRCSVEAKENRVANAS--GQEEKGPKRIRLEGEASI
SEQ ID NO: 94    GLAQGK-PRDRRTGFKPYKRCSVEARESRLN-SN--SQDQFKCPKRIRLEGFAST
SEQ ID NO: 4     GVGTCKSLKTRQTGFKPYKRCSMEVKESQVGNIN--NQSDEKVCKRLRLEGEAST
SEQ ID NO: 100   -------AKPRRTGFKPYKRCSATP--------T--HASGENDRKRIRLQNEPSL
SEQ ID NO: 104   -------SKPRRTGFKPYKRSSASP--------V--HASSENDVKRLRLQNESFP
SEQ ID NO: 2     GLDASKLMSRGRTGFKPYKRCSMEAKESRILNNNPIIHVEQKDPKRMRLETQAST
SEQ ID NO: 72    NELSNLKLKSRRTGFKPYKRCSVEAKENRVP------ASDEVGTKRIRLESEAST
SEQ ID NO: 102   ----------------------------------------------------------
SEQ ID NO: 16    -----------ASGFRPYKRCLSEREVTSSLTLVASDEKKSQ--RARIC------
SEQ ID NO: 24    -----------ASGFRPYKRCLSEREVTSSLTLVASDEKKSQ--RARIC------
SEQ ID NO: 78    ---------TLLQRGFMPYKRCAAESE-LLRSEAAGGEEAVADGELTRLCL-----
SEQ ID NO: 108   ---------S-LQRGFMPYKRCAAESE-SLRSEAPREE---TDGELTRLCL-----
SEQ ID NO: 80    ---------C--RRGFVPYKRCVADSEALLKSQAPQEE---ADGEMTRLCL-----
SEQ ID NO: 34    -----------MRGFMPYKKRVKVEENIDNVKLSYPLW-----------------
SEQ ID NO: 112   ----------------------------------------------------------
SEQ ID NO: 114   ----------------------------------------------------------
SEQ ID NO: 116   ----------------------------------------------------------
SEQ ID NO: 82    --------PSANSAFVRVKPSNSGDEEVIRGFVPYKRCKFQ--------------
SEQ ID NO: 110   ----------------------------------------------------------
SEQ ID NO: 118   --------EACGKGFVPYKRCIS-------VVTADNREEQCIHLSL---------
SEQ ID NO: 106   --------KTCGKGFVPYKRCMAERENQCSSVYYEEREEQRIKLSL---------
SEQ ID NO: 132   ----------------------------------------------------------
SEQ ID NO: 120   ----------------------------------------------------------
SEQ ID NO: 18    ----------------------------------------------------------
SEQ ID NO: 22    ----------------------------------------------------------
SEQ ID NO: 30    ----------------------------------------------------------
SEQ ID NO: 44    ----------------------------------------------------------
SEQ ID NO: 36    ----------------------------------------------------------
SEQ ID NO: 74    ----------------------------------------------------------
SEQ ID NO: 20    ----------------------------------------------------------
SEQ ID NO: 68    ----------------------------------------------------------
SEQ ID NO: 46    ----------------------------------------------------------
SEQ ID NO: 54    ----------------------------------------------------------
SEQ ID NO: 48    ----------------------------------------------------------
SEQ ID NO: 56    ----------------------------------------------------------
SEQ ID NO: 38    ----------------------------------------------------------
SEQ ID NO: 40    ----------------------------------------------------------
SEQ ID NO: 70    ----------------------------------------------------------
SEQ ID NO: 76    ----------------------------------------------------------
SEQ ID NO: 26    ----------------------------------------------------------
SEQ ID NO: 32    ----------------------------------------------------------
SEQ ID NO: 28    ----------------------------------------------------------
SEQ ID NO: 62    ----------------------------------------------------------
SEQ ID NO: 64    ----------------------------------------------------------
SEQ ID NO: 60    ----------------------------------------------------------
SEQ ID NO: 58    ----------------------------------------------------------
SEQ ID NO: 50    ----------------------------------------------------------
```

FIGURE 2 B (continued)

SEQ ID NO: 1, CCA1-like encoding nucleic acid
ATGGAGACAAATTCGTCTGGAGAAGATCTGGTTATTAAGACTCGGAAGCCATATACGATAACAAAG
CAACGTGAAAGGTGGACTGAGGAAGAACATAATAGATTCATTGAAGCTTTGAGGCTTTATGGTAGA
GCATGGCAGAAGATTGAAGAACATGTAGCAACAAAAACTGCTGTCCAGATAAGAAGTCACGCTCAG
AAATTTTTCTCCAAGGTAGAGAAGAGGCTGAAGCTAAAGGTGTAGCTATGGGTCAAGCGCTAGAC
ATAGCTATTCCTCCTCCACGGCCTAAGCGTAAACCAAACAATCCTTATCCTCGAAAGACGGGAAGT
GGAACGATCCTTATGTCAAAAACGGGTGTGAATGATGGAAAAGAGTCCCTTGGATCAGAAAAGTG
TCGCATCCTGAGATGGCCAATGAAGATCGACAACAATCAAAGCCTGAAGAGAAAACTCTGCAGGAA
GACAACTGTTCAGATTGTTTCACTCATCAGTATCTCTCTGCTGCATCCTCCATGAATAAAAGTTGT
ATAGAGACATCAAACGCAAGCACTTTCCGCGAGTTCTTGCCTTCACGGGAAGAGGGAAGTCAGAAT
AACAGGGTAAGAAAGGAGTCAAACTCAGATTTGAATGCAAAATCTCTGGAAAACGGTAATGAGCAA
GGACCTCAGACTTATCCGATGCATATCCCTGTGCTAGTGCCATTGGGGAGCTCAATAACAAGTTCT
CTATCACATCCTCCTTCAGAGCCAGATAGTCATCCCCACACAGTTGCAGGAGATTATCAGTCGTTT
CCTAATCATATAATGTCAACCCTTTTACAAACACCGGCTCTTTATACTGCCGCAACTTTCGCCTCA
TCATTTTGGCCTCCCGATTCTAGTGGTGGCTCACCTGTTCCAGGGAACTCACCTCCGAATCTGGCT
GCCATGGCCGCAGCCACTGTTGCAGCTGCTAGTGCTTGGTGGGCTGCCAATGGATTATTACCTTTA
TGTGCTCCTCTTAGTTCAGGTGGTTTCACTAGTCATCCTCCATCTACTTTTGGACCATCATGTGAT
GTAGAGTACACAAAAGCAAGCACTTTACAACATGGTTCTGTGCAGAGCCGAGAGCAAGAACACTCC
GAGGCATCAAAGGCTCGATCTTCACTGGACTCAGAGGATGTTGAAAATAAGAGTAAACCAGTTTGT
CATGAGCAGCCTTCTGCAACACCTGAGAGTGATGCAAAGGGTTCAGATGGAGCAGGAGACAGAAAA
CAAGTTGACCGGTCCTCGTGTGGCTCAAACACTCCGTCGAGTAGTGATGATGTTGAGGCGGATGCA
TCAGAAAGGCAAGAGGATGGCACCAATGGTGAGGTGAAAGAAACGAATGAAGACACTAATAAACCT
CAAACTTCAGAGTCCAATGCACGCCGCAGTAGAATCAGCTCCAATATAACCGATCCATGGAAGTCT
GTGTCTGACGAGGGTCGAATTGCCTTCCAAGCTCTCTTCTCCAGAGAGGTATTGCCGCAAAGTTTT
ACATATCGAGAAGAACACAGAGAGGAAGAACAACAACAACAAGAACAAAGATATCCAATGGCACTT
GATCTTAACTTCACAGCTCAGTTAACACCAGTTGATGATCAAGAGGAGAAGAGAAACACAGGATTT
CTTGGAATCGGATTAGATGCTTCAAAGCTAATGAGTAGAGGAAGAACAGGTTTTAAACCATACAAA
AGATGTTCCATGGAAGCCAAAGAAAGTAGAATCCTCAACAACAATCCTATCATTCATGTGGAACAG
AAAGATCCCAAACGGATGCGGTTGGAAACTCAAGCTTCCACATGA

SEQ ID NO: 2, CCA1-like protein sequence
METNSSGEDLVIKTRKPYTITKQRERWTEEEHNRFIEALRLYGRAWQKIEEHVATKTAVQIRSHAQ
KFFSKVEKEAEAKGVAMGQALDIAIPPPRPKRKPNNPYPRKTGSGTILMSKTGVNDGKESLGSEKV
SHPEMANEDRQQSKPEEKTLQEDNCSDCFTHQYLSAASSMNKSCIETSNASTFREFLPSREEGSQN
NRVRKESNSDLNAKSLENGNEQGPQTYPMHIPVLVPLGSSITSSLSHPPSEPDSHPHTVAGDYQSF
PNHIMSTLLQTPALYTAATFASSFWPPDSSGGSPVPGNSPPNLAAMAAATVAAASAWWAANGLLPL
CAPLSSGGFTSHPPSTFGPSCDVEYTKASTLQHGSVQSREQEHSEASKARSSLDSEDVENKSKPVC
HEQPSATPESDAKGSDGAGDRKQVDRSSCGSNTPSSSDDVEADASERQEDGTNGEVKETNEDTNKP
QTSESNARRSRISSNITDPWKSVSDEGRIAFQALFSREVLPQSFTYREEHREEEQQQQEQRYPMAL
DLNFTAQLTPVDDQEEKRNTGFLGIGLDASKLMSRGRTGFKPYKRCSMEAKESRILNNNPIIHVEQ
KDPKRMRLETQAST

SEQ ID NO: 3, AY519507 Arabidopsis thaliana MYB transcription factor (At1g01060) mRNA, complete cds
ATGGATACTAATACATCTGGAGAAGAATTATTAGCTAAGGCAAGAAAGCCATATACAATAACAAAG
CAGCGAGAGCGATGGACTGAGGATGAGCATGAGAGGTTTCTAGAAGCCTTGAGGCTTTATGGAAGA
GCTTGGCAACGAATTGAAGAACATATTGGGACAAAGACTGCTGTTCAGATCAGAAGTCATGCACAA
AAGTTCTTCACAAAGTTGGAGAAAGAGGCTGAAGTTAAAGGCATCCCTGTTTGCCAAGCTTTGGAC

FIGURE 4

```
ATAGAAATTCCGCCTCCTCGTCCTAAACGAAAACCCAATACTCCTTATCCTCGAAAGCCTGGGAAC
AACGGTACATCTTCCTCTCAAGTATCATCAGCAAAAGATGCAAAACTTGTTTCATCGGCCTCTTCT
TCACAGTTGAATCAGGCGTTCTTGGATTTGGAAAAAATGCCGTTCTCTGAGAAAACATCAACTGGA
AAAGAAAATCAAGATGAGAATTGCTCGGGTGTTTCTACTGTGAACAAGTATCCCTTACCAACGAAA
CAGGTAAGTGGCGACATTGAAACAAGTAAGACCTCAACTGTGGACAACGCGGTTCAAGATGTTCCC
AAGAAGAACAAAGACAAAGATGGTAACGATGGTACTACTGTGCACAGCATGCAAAACTACCCTTGG
CATTTCCACGCAGATATTGTGAACGGGAATATAGCAAATGCCCTCAAAATCATCCCTCAGGTATG
GTATCTCAAGACTTCATGTTTCATCCTATGAGAGAAGAAACTCACGGGCACGCAAATCTTCAAGCT
ACAACAGCATCTGCTACTACTACAGCTTCTCATCAAGCGTTTCCAGCTTGTCATTCACAGGATGAT
TACCGTTCGTTTCTCCAGATATCATCTACTTTCTCCAATCTTATTATGTCAACTCTCCTACAGAAT
CCTGCAGCTCATGCTGCAGCTACATTCGCTGCTTCGGTCTGGCCTTATGCGAGTGTCGGGAATTCT
GGTGATTCATCAACCCCAATGAGCTCTTCTCCTCCAAGTATAACTGCCATTGCCGCTGCTACAGTA
GCTGCTGCAACTGCTTGGTGGGCTTCTCATGGACTTCTTCCTGTATGCGCTCCAGCTCCAATAACA
TGTGTTCCATTCTCAACTGTTGCAGTTCCAACTCCAGCAATGACTGAAATGGATACCGTTGAAAAT
ACTCAACCGTTTGAGAAACAAAACACAGCTCTGCGAGATCAAAACTTGGCTTCGAAATCTCCAGCT
TCATCATCTGATGATTCAGATGAGACTGGAGTAACCAAGCTAAATGCCGACTCAAAAACCAATGAT
GATAAAATTGAGGAGGTTGTTGTTACTGCCGCTGTGCATGACTCAAACACTGCCCAGAAGAAAAAT
CTTGTGGACCGCTCATCCTGTGGCTCAAATACACCTTCAGGGAGTGACGCAGAAACTGATGCATTA
GATAAAATGGAGAAAGATAAAGAGGATGTGAAGGAGACAGATGAGAATCAGCCAGATGTTATTGAG
TTAAATAACCGTAAGATTAAAATGAGAGACAACAACAGCAACAACAATGCAACTACTGATTCGTGG
AAGGAAGTCTCCGAAGAGGGTCGTATAGCGTTTCAGGCTCTCTTTGCAAGGGAAAGATTGCCTCAA
AGCTTTTCGCCTCCTCAAGTGGCAGAGAATGTGAATAGAAAACAAAGTGACACGTCAATGCCATTG
GCTCCTAATTTCAAAAGCCAGGATTCTTGTGCTGCAGACCAAGAAGGAGTAGTAATGATCGGTGTT
GGAACATGCAAGAGTCTTAAAACGAGACAGACAGGATTTAAGCCATACAAGAGATGTTCAATGGAA
GTGAAAGAGAGCCAAGTTGGGAACATAAACAATCAAAGTGATGAAAAAGTCTGCAAAAGGCTTCGA
TTGGAAGGAGAAGCTTCTACATGA
```

SEQ ID NO: 4, AT1G01060.1 Arabidopsis MYB-related family transcription factor, protein sequence 645AA

```
MDTNTSGEELLAKARKPYTITKQRERWTEDEHERFLEALRLYGRAWQRIEEHIGTKTAVQIRSHAQ
KFFTKLEKEAEVKGIPVCQALDIEIPPPRPKRKPNTPYPRKPGNNGTSSSQVSSAKDAKLVSSASS
SQLNQAFLDLEKMPFSEKTSTGKENQDENCSGVSTVNKYPLPTKQVSGDIETSKTSTVDNAVQDVP
KKNKDKDGNDGTTVHSMQNYPWHFHADIVNGNIAKCPQNHPSGMVSQDFMFHPMREETHGHANLQA
TTASATTTASHQAFPACHSQDDYRSFLQISSTFSNLIMSTLLQNPAAHAAATFAASVWPYASVGNS
GDSSTPMSSSPPSITAIAAATVAAATAWWASHGLLPVCAPAPITCVPFSTVAVPTPAMTEMDTVEN
TQPFEKQNTALQDQNLASKSPASSSDDSDETGVTKLNADSKTNDDKIEEVVVTAAVHDSNTAQKKN
LVDRSSCGSNTPSGSDAETDALDKMEKDKEDVKETDENQPDVIELNNRKIKMRDNNSNNNATTDSW
KEVSEEGRIAFQALFARERLPQSFSPPQVAENVNRKQSDTSMPLAPNFKSQDSCAADQEGVVMIGV
GTCKSLKTRQTGFKPYKRCSMEVKESQVGNINNQSDEKVCKRLRLEGEAST
```

SEQ ID NO: 5, AJ937209.1 Arabidopsis thaliana mRNA for myb transcription factor LHY-CCA1-like1 (lcl1 gene)

```
ATGACCTCAACCAATCCGGTGGTCGCCGAAGTAATACCGGCGGAAACTTCTACAGATGCTACAGAG
ACGACGATTGCAACGACGGAAGCTGGTGAAGCACCGGAGAAGAAGGTGAGGAAAGCTTACACAATC
ACCAAGTCTAGAGAGAGTTGGACTGAAGGAGAACACGACAAGTTTCTGGAAGCTCTTCAATTGTTT
GATCGTGACTGGAAAAAGATAGAAGATTTTGTTGGTTCAAAGACAGTTATTCAGATCAGGAGCCAT
GCCCAAAAATACTTTCTAAAGGTCCAAAAAAATGGGACTTTAGCACATGTTCCACCCCCTAGGCCT
```

FIGURE 4 (continued)

```
AAGCGCAAAGCTGCTCATCCATATCCTCAAAAGGCATCGAAAAATGCTCAAATGTCGCTTCACGTT
TCCATGTCCTTTCCTACTCAAATAAATAACCTGCCTGGATATACTCCATGGGATGATGATACATCT
GCATTGTTAAACATTGCTGTAAGTGGGGTTATTCCACCAGAAGATGAACTTGATACTCTTTGTGGA
GCAGAAGTTGATGTTGGATCAAATGACATGATAAGTGAAACTAGTCCTTCAGCATCTGGTATCGGA
AGCTCAAGCAGAACACTATCAGATTCTAAGGGTTTGAGACTGGCGAAACAAGCTCCCTCAATGCAT
GGTCTTCCTGATTTTGCTGAGGTTTATAACTTCATTGGGAGTGTGTTCGATCCTGACAGCAAAGGC
CGCATGAAAAAGCTCAAGGAAATGGATCCTATAAATTTCGAAACTGTTTTGCTGTTGATGAGAAAC
CTCACAGTGAACTTGTCAAACCCTGACTTTGAACCTACTTCTGAATATGTTGATGCTGCAGAGGAA
GGTCATGAACACTTAAGCTCTTAG
```

SEQ ID NO: 6, AJ937209.1 Arabidopsis thaliana myb transcription factor LHY-CCA1-like1 (lcl1 gene)
```
MTSTNPVVAEVIPAETSTDATETTIATTEAGEAPEKKVRKAYTITKSRESWTEGEHDKFLEALQLF
DRDWKKIEDFVGSKTVIQIRSHAQKYFLKVQKNGTLAHVPPPRPKRKAAHPYPQKASKNAQMSLHV
SMSFPTQINNLPGYTPWDDDTSALLNIAVSGVIPPEDELDTLCGAEVDVGSNDMISETSPSASGIG
SSSRTLSDSKGLRLAKQAPSMHGLPDFAEVYNFIGSVFDPDSKGRMKKLKEMDPINFETVLLLMRN
LTVNLSNPDFEPTSEYVDAAEEGHEHLSS
```

SEQ ID NO: 7, AJ937210.1 Arabidopsis thaliana mRNA for myb transcription factor LHY-CCA1-like2 (lcl2 gene)
```
ATGGTCTCTAGAAATTCTGACGGATATTTCTTGGATCCGACCGGTATGACTGTTCCTGGTCTCGGA
CCTTCCTTTACAGCCGCCGTTTCTTCTTCTTCTTCACCAACGACTTCTTCTACGGCCGTGGCTGTG
GCGGATGTGACGGCGATGGTTTCTTCTTCGGAGGAGGATTTGAGTAAGAAGATTAGGAAGCCTTAT
ACTATTACTAAGTCTAGAGAGAGCTGGACGGAGCCTGAGCATGATAAATTCCTTGAAGCTCTTCAA
TTGTTTGATAGAGACTGGAAGAAGATTGAAGCTTTTATTGGTTCAAAGACAGTGATTCAGATACGA
AGTCATGCTCAGAAGTATTTTCTTAAGGTACAAAAGAGTGGGACCGGTGAACATCTCCCTCCTCCT
CGACCTAAAAGGAAAGCCGCTCATCCATATCCTCAGAAGGCTCACAAGAATGTGCAACTGCAAGTA
CCAGGGTCATTCAAGTCAACATCTGAACCAAATGACCCAAGTTTTATGTTTAGGCCTGAGTCTTCT
TCAATGCTGATGACTTCGCCAACCACTGCTGCTGCGGCTCCATGGACAAATAATGCGCAAACAATT
AGCTTCACTCCCCTCCCAAAGGAGCAGGAGCTAATAACAATTGTTCTAGTAGTTCTGAAAATACT
CCAAGACCACGATCCAACAGGGACGCAAGAGACCATGGAAATGTTGGCCATTCATTAAGAGTTTTA
CCGGACTTTGCCCAAGTATACGGCTTCATTGGAAGTGTGTTTGACCCATATGCAAGTAATCATCTA
CAAAAGCTGAAGAAGATGGACCCCATAGATGTTGAAACAGTGTTACTATTGATGAGAAATCTATCC
ATCAACTTGTCTAGTCCTGACTTTGAGGATCATAGACGGCTTCTTTCGTCTTATGATATCGGATCT
GAGACAGCAACTGATCATGGTGGAGTGAATAAAACCTTAAACAAAGACCCACCTGAAATCTCTACT
TAA
```

SEQ ID NO: 8, AJ937210.1 Arabidopsis thaliana myb transcription factor LHY-CCA1-like2 (lcl2 gene)
```
MVSRNSDGYFLDPTGMTVPGLGPSFTAAVSSSSSPTTSSTAVAVADVTAMVSSSEEDLSKKIRKPY
TITKSRESWTEPEHDKFLEALQLFDRDWKKIEAFIGSKTVIQIRSHAQKYFLKVQKSGTGEHLPPP
RPKRKAAHPYPQKAHKNVQLQVPGSFKSTSEPNDPSFMFRPESSSMLMTSPTTAAAAPWTNNAQTI
SFTPLPKGAGANNNCSSSSENTPRPRSNRDARDHGNVGHSLRVLPDFAQVYGFIGSVFDPYASNHL
QKLKKMDPIDVETVLLMRNLSINLSSPDFEDHRRLLSSYDIGSETATDHGGVNKTLNKDPPEIST
```

FIGURE 4 (continued)

SEQ ID NO: 9, AJ937211.1 Arabidopsis thaliana mRNA for myb transcription factor LHY-CCA1-like3 (lcl3 gene)
ATGGTGACTGTAAACCCTAGCCAAGCTCATTGTTTGCCTATGAAAATGAGTCTACCGGGTTTCAAT
ACTCTTCCCCACACGGCAACAACGATACCGGTTTCCATACGGAGCAATAGGACGATGTCGTTTTTT
GAGGATCCAACAAAGAAGGTTAGAAAGCCTTACACTATCACCAAATCTAGAGAGAACTGGACGGAG
CAAGAACACGACAAGTTCCTTGAAGCCCTTCATCTATTTGACCGGGATTGGAAGAAAATAAAGGCC
TTTGTTGGATCAAAAACAGTGATACAGATACGAAGCCACGCACAGAAGTACTTTCTCAAAGTTCAG
AAGAATGGGACTAAAGAACATCTCCCACCTCCTCGACCAAAGAGGAAAGCCAATCACCCATATCCA
CAAAAAGCTCCTAAATTTACTCTTTCTTCTTCAAACGCATTATTTCAACATGACTACTTATACAAC
ACTAATTCACATCCGGTGATTAGCACCACCCGTAAGCATGGATTAGTGCATTGCGATGTTAGTATA
CCAAGTTCTGTTATCAAAGAGGAATTTGGTGTCTCAGAGAACTGTTGCAGCACTAGTAGTAGTAGA
GATAAGCAGAGGACTAGAATCGTTACAGAGACAAATGACCAAGAAAGTTGTGGAAAGCCACATAGA
GTGGCGCCAAATTTCGCTGAAGTTTACAATTTTATAGGAAGTGTGTTTGATCCTAAAACAACAGGT
CATGTCAAGAGATTAAAGGAAATGGATCCAATAAATCTTGAGACGGTTCTCTTACTGATGAAAAAT
TTATCTGTAAACCTGACGAGTCCCGAGTTTGATGAACAACGGAAGTTGATATCATCTTACAACGCC
AGTTAG

SEQ ID NO: 10, AJ937211.1 Arabidopsis thaliana myb transcription factor LHY-CCA1-like3 (lcl3 gene)
MVTVNPSQAHCLPMKMSLPGFNTLPHTATTIPVSIRSNRTMSFFEDPTKKVRKPYTITKSRENWTE
QEHDKFLEALHLFDRDWKKIKAFVGSKTVIQIRSHAQKYFLKVQKNGTKEHLPPPRPKRKANHPYP
QKAPKFTLSSSNALFQHDYLYNTNSHPVISTTRKHGLVHCDVSIPSSVIKEEFGVSENCCSTSSSR
DKQRTRIVTETNDQESCGKPHRVAPNFAEVYNFIGSVFDPKTTGHVKRLKEMDPINLETVLLLMKN
LSVNLTSPEFDEQRKLISSYNAS

SEQ ID NO: 11, AJ937212.1 Arabidopsis thaliana mRNA for myb transcription factor LHY-CCA1-like4 (lcl4 gene)
ATGGTGTCCGTAAACCCTAGACCTAAGGGTTTTCCAGTTTTCGATTCCTCGAATATGAGTTTACCA
AGCTCCGATGGATTTGGTTCGATTCCGGCCACGGGACGGACCAGTACGGTGTCGTTTTCTGAGGAT
CCGACGACGAAGATTCGGAAGCCGTACACAATCAAGAAGTCGAGAGAGAATTGGACAGATCAAGAG
CACGATAAATTTCTAGAAGCTCTTCACTTATTCGATAGGGATTGGAAGAAAATAGAAGCCTTTGTT
GGATCAAAAACAGTAGTTCAGATACGAAGCCACGCTCAGAAATACTTTCTCAAAGTTCAGAAGAGT
GGTGCTAACGAACATCTTCCACCTCCTCGACCTAAGAGGAAAGCGAGTCATCCTTATCCTATAAAG
GCTCCTAAAAATGTTGCTTATACCTCTCTCCCGTCTTCGAGTACATTACCGTTGCTTGAGCCTGGT
TATTTGTATAGCTCTGATTCGAAGTCATTGATGGGAAACCAGGCTGTTTGTGCATCTACCTCTTCT
TCGTGGAATCATGAATCGACAAATCTGCCAAAACCGGTGATTGAAGAGGAACCGGGAGTCTCGGCC
ACGGCTCCTCTCCCAAATAATCGCTGCAGACAGGAAGATACAGAGAGGGTACGAGCAGTGACAAAG
CCAAATAACGAAGAAAGTTGTGAAAAGCCACATAGAGTGATGCCGAATTTTGCTGAAGTTTACAGC
TTCATTGGAAGTGTCTTCGATCCCAACACATCAGGCCACCTCCAGAGATTAAAGCAGATGGATCCA
ATAAATATGGAAACGGTTCTTTTACTGATGCAAAACCTGTCTGTAAATCTGACAAGTCCCGAGTTT
GCAGAGCAAAGGAGGTTGATATCATCATACAGCGCTAAAGCTTTGAAATAG

SEQ ID NO: 12, AJ937212.1 Arabidopsis thaliana myb transcription factor LHY-CCA1-like4 (lcl4 gene)
MVSVNPRPKGFPVFDSSNMSLPSSDGFGSIPATGRTSTVSFSEDPTTKIRKPYTIKKSRENWTDQE
HDKFLEALHLFDRDWKKIEAFVGSKTVVQIRSHAQKYFLKVQKSGANEHLPPPRPKRKASHPYPIK
APKNVAYTSLPSSSTLPLLEPGYLYSSDSKSLMGNQAVCASTSSSWNHESTNLPKPVIEEEPGVSA
TAPLPNNRCRQEDTERVRAVTKPNNEESCEKPHRVMPNFAEVYSFIGSVFDPNTSGHLQRLKQMDP
INMETVLLLMQNLSVNLTSPEFAEQRRLISSYSAKALK

FIGURE 4 (continued)

SEQ ID NO: 13, AJ937213.1 Arabidopsis thaliana mRNA for myb transcription factor LHY-CCA1-like5 (lcl5 gene), variant 1
ATGAGCTCGTCGCCGTCAAGAAATCCAACGAACGCCGAAGCACCTCCGCCACCACCAACATCGACG
GATGCTGTGGCAGAGGGTTCGTCTAAGAAAGTGAGGAAACCATATACCATCACCAAGTCAAGAGAG
AGCTGGACAGAGGAAGAGCACGATAAGTTTCTTGAAGCACTTCAACTGTTTGATCGTGACTGGAAG
AAGATTGAAGATTTTGTTGGTTCAAAGACTGTGATTCAGATAAGGAGTCATGCTCAAAAATACTTT
CTCAAGGTTCAGAAAAACGGGACATTAGCTCATGTGCCACCTCCTCGACCTAAGCGCAAAGCAGCT
CATCCGTATCCTCAAAAGGCATCAAAGAACGCTCAAATGCCACTTCAAGTTTCCACGTCTTTTACT
ACTACGCGAAATGGCGACATGCCGGGATATGCTTCATGGGATGATGCCTCAATGCTGCTAAACAGA
GTTATTTCACCACAACATGAACTTGCTACTCTTCGTGGAGCAGAAGCTGATATTGGATCAAAGGGC
TTATTAAATGTTAGTAGCCCTTCTACATCTGGCATGGGAAGCTCAAGCCGAACAGTATCAGGTTCT
GAGATTGTAAGAAAGGCTAAACAGCCTCCAGTGCTTCACGGTGTTCCTGATTTTGCTGAAGTTTAT
AATTTCATTGGGAGTGTCTTTGATCCTGAAACGAGAGGCCATGTGGAAAAGCTCAAGGAAATGGAT
CCTATAAATTTCGAAACTGTTCTGTTATTGATGAGAAACCTCACAGTTAACTTATCAAACCCTGAT
TTAGAATCCACTTCGGATTGTAATGATGCTGCAGAGGAAAGTCCTCTTATCATATGA

SEQ ID NO: 14, AJ937213.1 Arabidopsis thaliana myb transcription factor LHY-CCA1-like5 (lcl5 gene), variant 1
MSSSPSRNPTNAEAPPPPPTSTDAVAEGSSKKVRKPYTITKSRESWTEEEHDKFLEALQLFDRDWK
KIEDFVGSKTVIQIRSHAQKYFLKVQKNGTLAHVPPRPKRKAAHPYPQKASKNAQMPLQVSTSFT
TTRNGDMPGYASWDDASMLLNRVISPQHELATLRGAEADIGSKGLLNVSSPSTSGMGSSSRTVSGS
EIVRKAKQPPVLHGVPDFAEVYNFIGSVFDPETRGHVEKLKEMDPINFETVLLLMRNLTVNLSNPD
LESTSDCNDAAEESPLII

SEQ ID NO: 15, AY550299.1, Arabidopsis thaliana MYB transcription factor (At1g18330) mRNA, complete cds
ATGGCCGCTGAGGATCGAAGTGAGGAACTAAGCAGCAATGTAGAAAATGGAAGTTGCAATTCCAAT
GAAGGAATTAATCCTGAAACCAGCAGTCATTGGATTGAAAACGTTGTCAAGGTTAGGAAACCGTAC
ACAGTAACTAAGCAGAGAGAGAAGTGGAGTGAGGAAGAGCATGATAGGTTTCTTGAAGCTATCAAG
CTTTATGGTCGTGGTTGGCGTCAAATCCAAGAACACATAGGTACAAAAACCGCTGTGCAGATACGA
AGCCATGCTCAAAAGTTCTTCTCCAAGATGGCTCAGGAAGCTGACAGTAGAAGTGAAGGATCGGTT
AAAGCGATTGTGATCCCGCCTCCTCGTCCAAAGAGAAAACCGGCACATCCTTATCCTCGGAAATCG
CCTGTTCCATATACTCAGTCTCCTCCACCAAATTTGTCAGCTATGGAGAAAGGAACCAAGTCTCCA
ACCTCAGTGTTATCATCGTTTGGTTCAGAGGATCAAGTCAATAGATGCTCTTCGCCTAATTCGTGT
ACCAGTGACATCCAATCCATTGGTGCAACTTCCATTGATAAAAGAATAACTACACAACATCCAAG
CAACCTTTCAAAGATGATTCTGACATTGGTTCAACACCCATTTCAAGCATTACTCTTTTCGGGAAG
ATTGTCCTTGTCGCGGAAGAATCTCACAAACCATCCTCTTACAATGATGATGATCTTAAACAAATG
ACGTGTCAGGAGAATCACTACTCAGGGATGCTAGTTGACACTAATTTATCTCTTGGTGTATGGGAA
ACGTTTTGTACTGGTTCTAATGCATTTGGCTCGGTTACAGAAGCATCTGAGAACTTGGAGAAAGT
GCAGAGCCGATAAGTTCTTCATGGAAACGGTTAAGCTCCTTAGAAAAACAAGGATCTTGTAATCCT
GTAAATGCAAGTGGGTTCAGGCCATACAAGAGATGCCTATCAGAAAGAGAAGTAACATCATCATTG
ACGCTGGTAGCTTCAGATGAAAAGAAAAGCCAAAGAGCACGTATATGCTAG

SEQ ID NO: 16, AAS58510.1, MYB transcription factor (At1g18330) [Arabidopsis thaliana]
MAAEDRSEELSSNVENGSCNSNEGINPETSSHWIENVVKVRKPYTVTKQREKWSEEEHDRFLEAIK
LYGRWRQIQEHIGTKTAVQIRSHAQKFFSKMAQEADSRSEGSVKAIVIPPPRPKRKAHPYPRKS
PVPYTQSPPPNLSAMEKGTKSPTSVLSSFGSEDQVNRCSSPNSCTSDIQSIGATSIDKKNNYTTSK QPFKDDSDIGSTPISSITLFGKIVLVAEEESHKPSSYNDDDLKQMTCQENHYSGMLVDTNLSLGVWE
TFCTGSNAFGSVTEASENLEKSAEPISSSWKRLSSLEKQGSCNPVNASGFRPYKRCLSEREVTSSL
TLVASDEKKSQRARIC SEQ ID NO: 17, AY079415.1, Arabidopsis thaliana putative Myb-related transcription activator protein (At1g19000) mRNA, complete cds
ATGGCCGCCGTTAGTAGTTCGTCGGAGACCGGAGACTGCGGCGTTACGGGAAAGAGAGATGAGATC
ATGTTGTTCGGAGTTAGAGTCGTGGTTGATCCGATGAGAAAGTGTGTGAGTTTGAACAATCTCTCT
GATTATGAAAAGTCTTCTCCGGAGGATGAGATCCCTAAGATAGTCACCGCCGGAGCTGGAGATGGT
GAAGATAAGAACGAAACGGATGCGACGGTGATTGTCGCTGACGGTTACGCCTCCGCCAATGACGCT
GTCCAGATTTCGTCTTCTTCCGGCGGGAGGAAACGAGGGGTTCCATGGACAGAGAACGAGCATAAG
AGGTTCTTGATTGGGTTGCAGAAAGTAGGAAAAGGAGATTGGAAAGGAATATCAAGAAACTTTGTG
AAGAGTAGGACTCCTACTCAAGTAGCTAGTCATGCTCAGAAATACTTCCTCCGACGAACCAACCTC
AACCGTCGCCGAAGAAGATCTAGCCTTTTTGATATCACTACTGAGACGGTTACAGAAATGGCCATG
GAGCAAGATCCTACTCAGGAGAACTCACCACTACCTGAAACCAACATCAGCTCTGGACAGCAAGCG
ATGCAAGTTTTTACTGACGTGCCGACAAAAACTGAGAATGCACCAGAGACATTTCATCTCAACGAT
CCATATCTGGTTCCAGTAACCTTCCAAGCAAAGCCAACATTCAATCTAAACACAGATGCTGCTCCA
CTTTCTCTCAACCTTTGTCTGGCATCCTCATTTAATCTTAACGAGCAACCCAACTCAAGACACTCG
GCTTTCACGATGATGCCAAGCTTCAGCGATGGAGATAGCAATAGCAGCATCATCAGAGTTGCTTAG
AGCTTAAACCCAAGGTGAATCTACAAGACCT SEQ ID NO: 18, AAL85146.1, putative Myb-related transcription activator protein (At1g19000) [Arabidopsis thaliana]
MAAVSSSSETGDCGVTGKRDEIMLFGVRVVVDPMRKCVSLNNLSDYEKSSPEDEIPKIVTAGAGDG
EDKNETDATVIVADGYASANDAVQISSSSGGRKRGVPWTENEHKRFLIGLQKVGKGDWKGISRNFV
KSRTPTQVASHAQKYFLRRTNLNRRRRRSSLFDITTETVTEMAMEQDPTQENSPLPETNISSGQQA
MQVFTDVPTKTENAPETFHLNDPYLVPVTFQAKPTFNLNTDAAPLSLNLCLASSFNLNEQPNSRHS
AFTMMPSFSDGDSNSSIIRVA SEQ ID NO: 19, AY519509.1, Arabidopsis thaliana MYB transcription factor (At1g70000) mRNA, complete cds
ATGTCACGTAGTTGCTCACAGTGTGGAAACAACGGCCACAACTCTCGCACATGTCCGACGGACATA
ACTACCACCGGTGACAACAACGACAAAGGCGGCGGGGAGAAAGCCATCATGCTTTTTGGCGTCCGC
GTCACGGAAGCTTCATCATCTTGTTTTAGAAAAAGTGTTAGTATGAACAATCTCTCTCAATTCGAT
CAAACTCCTGATCCCAACCCAACCGATGACGGTGGTTACGCTTCAGACGACGTCGTTCACGCCTCC
GGTAGAAACCGTGAACGCAAACGAGGAACTCCATGGACAGAGGAAGAACATAGATTGTTTCTTACT
GGATTGCATAAAGTTGGAAAAGGTGATTGGAGAGGAATCTCTAGAAACTTTGTTAAAACTCGAACA
CCTACTCAGGTAGCGAGTCATGCTCAGAAATATTTTCTCCGGCGGACTAATCAGAATCGTCGTCGT
CGTAGATCAAGCCTCTTCGATATCACTCCCGATTCGTTTATAGGATCATCAAAAGAAGAGAATCAG
TTACAGACTCCATTGGAGCTAATCCGTCCAGTTCCGATTCCTATTCCGATTCCACCGTCGCGGAAG
ATGGCTGATTTGAATCTTAACAAGAAAAAACTCCAGCGACAACGGAGATGTTTCCGCTGTCGCTG
AATTTGCAGAGGCCGTCTTCGTCGACATCGTCATCGTCCAATGAACAGAAGGCACGTGGCTCACGT
GCCTCCTCGGGGTTCGAGGCGATGTCGAGTAATGGAGATAGTATAATGGGAGTGGCTTGA

FIGURE 4 (continued)

SEQ ID NO: 20, AAS09979.1, MYB transcription factor (At1g70000) [Arabidopsis thaliana]
MSRSCSQCGNNGHNSRTCPTDITTTGDNNDKGGGEKAIMLFGVRVTEASSSCFRKSVSMNNLSQFD
QTPDPNPTDDGGYASDDVVHASGRNRERKRGTPWTEEEHRLFLTGLHKVGKGDWRGISRNFVKTRT
PTQVASHAQKYFLRRTNQNRRRRRSSLFDITPDSFIGSSKEENQLQTPLELIRPVPIPIPPSRK
MADLNLNKKKTPATTEMFPLSLNLQRPSSSTSSSNEQKARGSRASSGFEAMSSNGDSIMGVA

SEQ ID NO: 21, AY519510.1, Arabidopsis thaliana MYB transcription factor (At1g74840) mRNA, complete cds
ATGGCCGACGGTAGTACTAGTTCTTCGGAGTCCACTACCGCCTGCGCTGGAAGCGGCACAAGAAGA
GAGATTATGCTGTTCGGAGTCAGGGTTGTGCTTGACCCGATGAGAAAGTGCGTGAGTTTGAACAAT
CTGTCTGACTATGAACAGACGGCGGAGACTCCAAAGATCGACGGCGAAGATAGAGATGAACAAGAT
ATGAACAAAACCCCGGCCGGTTACGCCTCGGCGGATGAAGCTCTTCCCATGTCTTCTTCTAACGGC
AAAATCGAGAGGAAACGAGGAGTTCCATGGACTGAAGAAGAACACAAGCTGTTCTTGCTTGGGCTG
CAGAGAGTCGGTAAAGGAGATTGGAAAGGAATATCAAGAAACTTTGTCAAGACCAGAACCTCTACA
CAAGTTGCTAGTCATGCTCAGAAATACTTCCTCAGGCGAAGTAATCTTAACCGTCGCCGCCGAAGA
TCTAGCCTTTTTGACATGACTACTGATACGGTCATACCCATGGAAGAAGATCACCAAGTGCTTATA
CAGGAGAACACATCTCAATCATCTTCTCCTGTACCGGAAATCAACAACTTCTCTATACATCCGGTT
ATGCAAGTCTTTCCCGAGTTCCCGGTACCAACAGGGAATCAATCATACGGACAGCTTACTTCATCG
AATCTCATCAATTTGGTTCCATTAACTTTTCAGTCAAGTCCAGCACCGCTTTCTCTCAACCTCTCA
CTAGCTTCATCTAATCTTAATGAACCATCTCCTTCAATGCATCCAGCATTCAACACGATTGGAGTC
GCTTAG

SEQ ID NO: 22, AAS09980.1, MYB transcription factor (At1g74840) [Arabidopsis thaliana]
MADGSTSSSESTTACAGSGTRREIMLFGVRVVLDPMRKCVSLNNLSDYEQTAETPKIDGEDRDEQD
MNKTPAGYASADEALPMSSSNGKIERKRGVPWTEEEHKLFLLGLQRVGKGDWKGISRNFVKTRTST
QVASHAQKYFLRRSNLNRRRRRSSLFDMTTDTVIPMEEDHQVLIQENTSQSSSPVPEINNFSIHPV
MQVFPEFPVPTGNQSYGQLTSSNLINLVPLTFQSSPAPLSLNLSLASSNLNEPSPSMHPAFNTIGV
A

SEQ ID NO: 23, NM_148701.1, Arabidopsis thaliana DNA binding / transcription factor (AT3G10113) mRNA, complete cds
ATGGTAATGATGATTATTATATATACCGAACCCGAAATCAGCTTGTTTCCACTTCAGGATCGAAGT
GAGGAACTAAGCAGCAATGTAGAAAATGGAAGTTGCAATTCCAATGAAGGAATTAATCCTGAAACC
AGCAGTCATTGGATTGAAAACGTTGTCAAGGTTAGGAAACCGTACACAGTAACTAAGCAGAGAGAG
AAGTGGAGTGAGGAAGAGCATGATAGGTTTCTTGAAGCTATCAAGCTTTATGGTCGTGGGTGGCGT
CAAATCCAAGAACACATAGGTACAAAAACCGCTGTACAGATACGAAGCCATGCTCAAAAGTTCTTC
TCCAAGATGGCTCAGGAAGCTGACAGTAGAAGTGAAGGATCGGTTAAAGCGATTGTGATCCCGCCT
CCTCGTCCAAAGAGAAAACCGGCACATCCTTATCCTCGGAAATCGCCTGTTCCATATACTCAGTCT
CCTCCACCAAATTTGTCAGCTATGGAGAAAGGAACCAAGTCTCCAACCTCAGTGTTATCATCGTTT
GGTTCAGAGGATCAAAATAACTACACAACATCCAAGCAACCTTTCAAAGATGATTCTGACATTGGT
TCAACACCCATTTCAAGCATTACTCTTTTCGGGAAGATTGTCCTTGTCGCGGAAGAATCTCACAAA
CCATCCTCTTACAATGATGATGATCTTAAACAAATGACGTGTCAGGAGAATCACTACTCAGGGATG
CTAGTTGACACTAATTTATCTCTTGGTGTATGGGAAACGTTTTGTACTGGTTCTAATGCATTTGGC
TCGGTTACAGAAGCATCTGAGAACTTGGAGAAGAGTGCAGAGCCGATAAGTTCTTCATGGAAACGG
TTAAGCTCCTTAGAAAAACAAGGATCTTGTAATCCTGTAAATGCAAGTGGGTCAGGCCATACAAG
AGATGCCTATCAGAAAGAGAAGTAACATCATCATTGACGCTGGTAGCTTCAGATGAAAAGAAAGC
CAAAGAGCACGTATATGCTAG FIGURE 4 (continued)

SEQ ID NO: 24, NP_683543.1| DNA binding / transcription factor
(AT3G10113) [Arabidopsis thaliana]
MVMMIIIYTEPEISLFPLQDRSEELSSNVENGSCNSNEGINPETSSHWIENVVKVRKPYTVTKQRE
KWSEEEHDRFLEAIKLYGRGWRQIQEHIGTKTAVQIRSHAQKFFSKMAQEADSRSEGSVKAIVIPP
PRPKRKPAHPYPRKSPVPYTQSPPPNLSAMEKGTKSPTSVLSSFGSEDQNNYTTSKQPFKDDSDIG
STPISSITLFGKIVLVAEESHKPSSYNDDDLKQMTCQENHYSGMLVDTNLSLGVWETFCTGSNAFG
SVTEASENLEKSAEPISSSWKRLSSLEKQGSCNPVNASGFRPYKRCLSEREVTSSLTLVASDEKKS
QRARIC SEQ ID NO: 25, NM_111894.1, Arabidopsis thaliana DNA binding /
transcription factor (AT3G10580) mRNA, complete cds
ATGGATGCAGCAATTCCGATTTGGAAGAGGGACGATGATAAGCGTTTTGAGTTAGCTCTGGTTCGA
TTCCCTGCTGAGGGTTCGCCGGATTTTTTAGAGAATATCGCTCAGTTTCTGCAGAAACCGTTAAAG
GAGGTGTACTCCTACTACCAAGCCTTGGTCGATGATGTTACGCTGATCGAATCGGGTAAGTATCCT
TTGCCCAAGTACCCGGAAGATGATTACGTGTCACTGCCGGAAGCGACTAAGTCTAAAACCCAGGGC
ACGGGGAAAAAGAAGGGAATACCTTGGTCACCAGAAGAACACAGATTGTTTTGGATGGACTAAAC
AAGTATGGGAAAGGAGATTGGAAGAGCATATCGAGGGAATGTGTGACGTCAAGGAGCCCGATGCAA
GTGGCAAGCCATGCTCAGAAGTATTTCTTAAGGCAAAAAAATAAGAAGGGGAAACGCTTCAGTATC
CATGATATGACTCTGGGAGATGCCGAAAATGTAACCGTCCCTGTATCCAACTTGAATTCTATGGGC
CAGCAGCCACATTTTGATGACCAAAGTCCTCCGGATCATTATCAAGACTACTTCTCCCAGAGCAAT
GTAACCATCCCTGGATGCAACATGCACTTTATGGGCCAGCAACCACGTTTTGGTGACCAAATTCCT
CCGGGTGAATATCACCCCTACTCCCGGGACAATGTAACCGTCACTGGATCCAACTTGAATTCTATT
GGCCAGCAGCCACATTTTAATGACCAAATTTCTCCGGATCAATATGGCCGCTACTTGCAGGAAAAC
TTCGGGTTTTTCGATGATGATGGTGAAGATGATGGGAGTTTAGCAAGCTTTCAACAACTATACAAG
GCTTAA SEQ ID NO: 26, NP_187669.1, DNA binding / transcription factor
(AT3G10580) [Arabidopsis thaliana]
MDAAIPIWKRDDDKRFELALVRFPAEGSPDFLENIAQFLQKPLKEVYSYYQALVDDVTLIESGKYP
LPKYPEDDYVSLPEATKSKTQGTGKKKGIPWSPEEHRLFLDGLNKYGKGDWKSISRECVTSRSPMQ
VASHAQKYFLRQKNKKGKRFSIHDMTLGDAENVTVPVSNLNSMGQQPHFDDQSPPDHYQDYFSQSN
VTIPGCNMHFMGQQPRFGDQIPPGEYHPYSRDNVTVTGSNLNSIGQQPHFNDQISPDQYGRYLQEN
FGFFDDDGEDDGSLASFQQLYKA SEQ ID NO: 27, AY550300.1, Arabidopsis thaliana MYB transcription
factor (At3g10590) mRNA, complete cds
ATGGCTTCGAGTCCACGCTGGACGGAGGACGACAACAGGCGTTTTAAGTCAGCTCTGTCGCAATTC
CCTCCGGATAACAAGCGTTTGGTGAATGTCGCCCAGCATCTGCCGAAACCTTTGGAGGAGGTGAAG
TACTACTACGAAAAGTTGGTCAACGATGTTTATCTGCCGAAACCTTTAGAGAATGTCACCCAGCAT
CTGCAGAAACCTATGGAAATGGAGGAGATGAAGTACATGTACGAAAGATGGCCAACGATGTTAAT
CAGATGCCCGAGTACGTACCACTGGCGGAATCGAGTCAGTCCAAACGCAGGAAGAAGGATACGCCA
AATCCTTGGACAGAAGAGGAACACAGATTGTTTCTGCAAGGATTGAAAAAGTATGGGGAAGGAGCT
TCGACGTTGACATCAACGAATTTTGTGAAGACAAAGACTCCACGGCAAGTGTCAAGCCATGCACAG
TATTACAAAAGGCAAAAATCGGACAATAAGAAGGAGAAACGCCGGAGTATTTTGACATAACTTTG
GAGTCTACCGAGGGCAATCCAGATTCTGGAAATCAGAACCCTCCGGATGATGATGATCCGTCCCAA
GGTCAAGGCACTTGTCTTGGAGTTTAG

FIGURE 4 (continued)

SEQ ID NO: 28, AAS58511.1, MYB transcription factor (At3g10590) [Arabidopsis thaliana]
MASSPRWTEDDNRRFKSALSQFPPDNKRLVNVAQHLPKPLEEVKYYYEKLVNDVYLPKPLENVTQH
LQKPMEMEEMKYMYEKMANDVNQMPEYVPLAESSQSKRRKKDTPNPWTEEEHRLFLQGLKKYGEGA
STLTSTNFVKTKTPRQVSSHAQYYKRQKSDNKKEKRRSIFDITLESTEGNPDSGNQNPPDDDDPSQ
GQGTCLGV

SEQ ID NO: 29, AY519512.1, Arabidopsis thaliana MYB transcription factor (At3g16350) mRNA, complete cds
ATGACTCGTCGGTGTTCGCATTGTAGCAACAATGGGCACAATTCACGCACGTGTCCAACGCGTGGT
GGTGGCACGTGCGGTGGAAGTGGCGGAGGAGGAGGAGGTGGTGGTGGAGGAGGGTCTGGTTCCTCC
TCCGCCATGAAGTTATTTGGTGTGAGGTTAACGGATGGCTCGATTATTAAAAAGAGTGCGAGTATG
GGTAATCTCTCGGCATTGGCTGTTGCGGCGGCGGCGGCAACGCACCACCGTTTATCTCCGTCGTCT
CCTCTGGCGACGTCAAATCTTAATGATTCGCCGTTATCGGATCATGCCCGATACTCTAATTTGCAT
CATAATGAAGGGTATTTATCTGATGATCCTGCTCATGGTTCTGGGTCTAGTCACCGTCGTGGTGAG
AGGAAGAGAGGTGTTCCTTGGACTGAAGAGGAACATAGACTATTCTTAGTCGGTCTTCAGAAACTC
GGGAAAGGAGATTGGCGCGGTATTTCGAGAAACTATGTAACGTCAAGAACTCCTACACAAGTGGCT
AGTCATGCTCAAAAGTATTTTATTCGACATACTAGTTCAAGCCGCAGGAAAAGACGGTCTAGCCTC
TTCGACATGGTTACAGATGAGATGGTAACCGATTCATCGCCAACACAGGAAGAGCAGACCTTAAAC
GGTTCCTCTCCAAGCAAGGAACCTGAAAAGAAAAGCTACCTTCCTTCACTTGAGCTCTCACTCAAT
AATACCACAGAAGCTGAAGAGGTCGTAGCCACGGCGCCACGACAGGAAAAATCTCAAGAAGCTATA
GAACCATCAAATGGTGTTTCACCAATGCTAGTCCCGGGTGGCTTCTTTCCTCCTTGTTTTCCAGTG
ACTTACACGATTTGGCTCCCTGCGTCACTTCACGGAACAGAACATGCCTTAAACGCTGAGACTTCT
TCTCAGCAGCATCAGGTCCTAAAACCAAAACCTGGATTTGCTAAAGAACGTGTGAACATGGACGAG
TTGGTCGGTATGTCTCAGCTTAGCATAGGAATGGCGACAAGACACGAAACCGAAACTTCCCCTTCC
CCGCTATCTTTGAGACTAGAGCCCTCAAGGCCATCAGCGTTTCACTCGAATGGCTCGGTTAATGGT
GCAGATTTGAGTAAAGGCAACAGCGCGATTCAGGCTATCTAA

SEQ ID NO: 30, AAS09982.1, MYB transcription factor (At3g16350) [Arabidopsis thaliana]
MTRRCSHCSNNGHNSRTCPTRGGGTCGGSGGGGGGGGGSGSSSAMKLFGVRLTDGSIIKKSASM
GNLSALAVAAAATHHRLSPSSPLATSNLNDSPLSDHARYSNLHHNEGYLSDDPAHGSGSSHRRGE
RKRGVPWTEEEHRLFLVGLQKLGKGDWRGISRNYVTSRTPTQVASHAQKYFIRHTSSSRRKRRSSL
FDMVTDEMVTDSSPTQEEQTLNGSSPSKEPEKKSYLPSLELSLNNTTEAEEVVATAPRQEKSQEAI
EPSNGVSPMLVPGGFFPPCFPVTYTIWLPASLHGTEHALNAETSSQQHQVLKPKPGFAKERVNMDE
LVGMSQLSIGMATRHETETSPSPLSLRLEPSRPSAFHSNGSVNGADLSKGNSAIQAI

SEQ ID NO: 31, AY122911.1, Arabidopsis thaliana unknown protein (At4g09450) mRNA, complete cds
ATGGCCGCGTTTCCGCAGTGGACAAGGGTCGATGACAAACGTTTTGAGTTAGCTCTGCTTCAAATC
CCGGAGGGTTCGCCGAATTTTATAGAGAATATCGCCTATTATCTCCAGAAACCGGTGAAGGAGGTG
GAGTACTACTACTGCGCGTTGGTCCATGATATTGAGCGGATCGAATCGGGTAAGTATGTTTTGCCC
AAATACCCGGAAGACGATTACGTGAAACTGACGGAAGCAGGTGAGTCTAAGGGCAATGGGAAAAAG
ACGGGAATTCCTTGGTCAGAAGAGGAACAGAGGTTGTTTCTGGAAGGACTAAATAAGTTTGGGAAA
GGAGACTGGAAGAACATATCGAGGTATTGTGTGAAGTCAAGGACCTCGACGCAAGTGGCAAGCCAT
GCTCAGAAGTATTTTGCAAGGCAAAAGCAGGAGAGTACGAATACTAAACGCCCGAGTATTCATGAC
ATGACTCTGGGAGTTGCGGTCAATGTCCCTGGATCCAACTTGGAGTCTACTGGCCAGCAACCACAT
TTTGGTGATCAAATTCCTTCGAATCAATATTATCCCTCCCAGGAAAACTTTCGGGGTTTTGATCAG
CGATGGTGATGGGTGTATGGCAAACTTATACTACGCTTAA FIGURE 4 (continued)

SEQ ID NO: 32, AAM67444.1, unknown protein (At4g09450) [Arabidopsis thaliana]
MAAFPQWTRVDDKRFELALLQIPEGSPNFIENIAYYLQKPVKEVEYYYCALVHDIERIESGKYVLP
KYPEDDYVKLTEAGESKGNGKKTGIPWSEEEQRLFLEGLNKFGKGDWKNISRYCVKSRTSTQVASH
AQKYFARQKQESTNTKRPSIHDMTLGVAVNVPGSNLESTGQQPHFGDQIPSNQYYPSQENFRGFDQ
RW

SEQ ID NO: 33, AY519515.1, Arabidopsis thaliana MYB transcription factor (At5g37260) mRNA, complete cds
ATGGCTATGCAGGAACGTTGTGAGAGTTTATGTTCTGATGAACTTATATCTTCCTCAGATGCCTTT
TACCTCAAGACAAGAAAGCCTTATACCATCACTAAACAAAGAGAGAAATGGACAGAAGCAGAGCAT
GAGAAGTTTGTAGAAGCATTGAAACTCTATGGCAGAGCTTGGAGACGAATCGAAGAACATGTTGGA
ACAAAAACTGCAGTTCAGATTCGAAGCCATGCGCAGAAGTTCTTTACTAAGGTTGCTCGCGATTTT
GGTGTTAGCTCTGAGTCCATTGAGATCCCGCCTCCAAGGCCAAAGAGAAAGCCGATGCATCCTTAC
CCTAGAAAGCTTGTGATTCCTGATGCAAAAGAGATGGTATACGCTGAACTAACCGGATCCAAGCTG
ATTCAGGATGAAGATAACCGATCTCCAACATCGGTTTTATCAGCTCATGGCTCAGATGGATTAGGT
TCCATTGGTTCAAATTCACCTAACTCTTCTTCAGCTGAGTTATCATCTCACACAGAGGAATCATTG
TCTCTAGAAGCAGAGACCAAACAGAGCCTTAAGCTCTTTGGAAAAACTTTTGTAGTTGGTGATTAC
AACTCTTCAATGAGTTGTGATGATTCTGAAGATGGCAAGAAGAAGCTATACTCAGAAACACAGTCT
CTTCAATGTTCTTCTTCTACTTCAGAAGACGCTGAAACAGAAGTGGTAGTGTCGGAGTTCAAAAGA
AGTGAGAGATCAGCTTTCTCTCAGTTAAAATCGTCGGTGACTGAGATGAACAACATGAGAGGGTTC
ATGCCTTACAAAAAGAGAGTAAAGGTGGAAGAAAACATTGACAATGTAAAATTATCATATCCTTTG
TGGTGA

SEQ ID NO: 34, AAS09985.1, MYB transcription factor (At5g37260) [Arabidopsis thaliana]
MAMQERCESLCSDELISSSDAFYLKTRKPYTITKQREKWTEAEHEKFVEALKLYGRAWRRIEEHVG
TKTAVQIRSHAQKFFTKVARDFGVSSESIEIPPPRPKRKPMHPYPRKLVIPDAKEMVYAELTGSKL
IQDEDNRSPTSVLSAHGSDGLGSIGSNSPNSSSAELSSHTEESLSLEAETKQSLKLFGKTFVVGDY
NSSMSCDDSEDGKKKLYSETQSLQCSSSTSEDAETEVVVSEFKRSERSAFSQLKSSVTEMNNMRGF
MPYKKRVKVEENIDNVKLSYPLW

SEQ ID NO: 35, AY519516.1, Arabidopsis thaliana MYB transcription factor (At5g47390) mRNA, complete cds
ATGACTCGTCGATGTTCTCACTGCAATCACAATGGCCACAACTCTCGGACTTGTCCCAATCGCGGC
GTGAAGCTCTTTGGTGTTCGGCTCACCGAAGGTTCGATCCGGAAAAGTGCAAGTATGGGTAATCTT
AGCCATTACACGGGTTCTGGATCGGGTGGGCATGGAACCGGGTCCAACACTCCGGGTTCTCCGGGT
GATGTCCCTGACCATGTCGCTGGTGATGGTTACGCTTCTGAGGATTTCGTTGCTGGCTCTTCCTCT
AGCCGCGAGAGAAAGAAGGAACTCCATGGACAGAGGAAGAACACAGGATGTTCTTATTAGGTTTA
CAGAAGCTGGGTAAAGGTGATTGGAGAGGTATCTCAAGAAACTATGTGACCACTAGGACACCTACA
CAAGTTGCTAGCCATGCTCAGAAGTATTTCATCAGACAATCCAATGTCTCTCGTCGCAAAAGACGT
TCTAGTCTCTTTGATATGGTTCCTGATGAGGTTGGAGATATTCCCATGGATTTGCAAGAACCAGAG
GAAGATAATATTCCTGTGGAAACTGAAATGCAAGGTGCTGACTCTATTCATCAGACACTTGCTCCT
AGCTCACTTCACGCACCGTCAATCTTGGAAATCGAAGAATGTGAATCAATGGACTCCACAAACTCT
ACCACCGGGGAACCAACCGCAACTGCCGCTGCTGCTTCTTCTTCCAGACTAGAAGAAACCACA
CAACTGCAATCACAACTGCAACCGCAGCCGCAACTACCTGGCTCATTCCCCATACTATATCCGACC
TACTTTTCACCATATTACCCGTTTCCATTCCCAATATGGCCTGCTGGTTATGTTCCTGAACCACCC AAGAAAGAGGAAACTCATGAAATTCTCAGACCAACTGCTGTGCACTCGAAAGCTCCTATCAATGTT
GACGAGCTTCTTGGTATGTCTAAGCTCAGCCTTGCAGAGTCCAACAAACATGGAGAATCCGATCAG
TCTCTTTCATTGAAGCTAGGTGGCGGGTCATCTTCAAGACAATCAGCATTTCACCCGAATCCTAGC
TCTGATAGTTCAGACATCAAAAGCGTGATACACGCTTTATAA

SEQ ID NO: 36, AAS09986.1, MYB transcription factor (At5g47390) [Arabidopsis thaliana]
MTRRCSHCNHNGHNSRTCPNRGVKLFGVRLTEGSIRKSASMGNLSHYTGSGSGGHGTGSNTPGSPG
DVPDHVAGDGYASEDFVAGSSSSRERKKGTPWTEEEHRMFLLGLQKLGKGDWRGISRNYVTTRTPT
QVASHAQKYFIRQSNVSRRKRRSSLFDMVPDEVGDIPMDLQEPEEDNIPVETEMQGADSIHQTLAP
SSLHAPSILEIEECESMDSTNSTTGEPTATAAAASSSSRLEETTQLQSQLQPQPQLPGSFPILYPT
YFSPYYPFPFPIWPAGYVPEPPKKEETHEILRPTAVHSKAPINVDELLGMSKLSLAESNKHGESDQ
SLSLKLGGGSSSRQSAFHPNPSSDSSDIKSVIHAL

SEQ ID NO: 37, AY519517.1, Arabidopsis thaliana MYB transcription factor (At5g56840) mRNA, complete cds
ATGGGCAGAAGATGCTCACACTGTGGAAACGTAGGACATAACTCAAGAACATGTTCTTCTTACCAA
ACAAGAGTAGTTAGGCTCTTTGGTGTTCATCTAGACACCACAAGCTCTTCTCCGCCGCCTCCTCCT
CCTCCCTCGATTTTGGCCGCTGCAATAAAGAAAAGTTTCAGCATGGATTGCTTGCCGGCATGTTCC
TCCTCTTCCTCTTCCTTTGCTGGTTATCTCTCCGATGGTCTCGCCCATAAAACACCTGACCGCAAA
AAAGGGGTTCCATGGACGGCGGAAGAGCACCGGACGTTTCTAATTGGATTAGAAAAGCTTGGAAAA
GGAGATTGGAGAGGAATCTCTAGAAACTTCGTCGTCACAAAATCCCCGACACAAGTGGCAAGTCAT
GCTCAAAAATACTTTCTCCGGCAAACTACCACTCTCCATCACAAGAGACGCCGCACCAGCCTCTTT
GATATGGTTTCGGCCGGCAATGTTGAAGAAAATAGTACTACTAAGAGGATATGTAATGATCATATT
GGGTCGAGCTCAAAGGTTGTTTGGAAACAAGGATTACTCAATCCTCGTCTTGGATATCCAGATCCG
AAAGTATCAGTATCCGGCTCGGGTAACTCCGGTGGACTCGATCTTGAGCTGAAGCTTGCGTCCATT
CAATCTCCTGAATCGAATATTAGACCTATTAGCGTTACGTGA

SEQ ID NO: 38, AAS09987.1| MYB transcription factor (At5g56840) [Arabidopsis thaliana]
MGRRCSHCGNVGHNSRTCSSYQTRVVRLFGVHLDTTSSSPPPPPPPSILAAAIKKSFSMDCLPACS
SSSSSFAGYLSDGLAHKTPDRKKGVPWTAEEHRTFLIGLEKLGKGDWRGISRNFVVTKSPTQVASH
AQKYFLRQTTTLHHKRRRTSLFDMVSAGNVEENSTTKRICNDHIGSSSKVVWKQGLLNPRLGYPDP
KVSVSGSGNSGGLDLELKLASIQSPESNIRPISVT

SEQ ID NO: 39, NM_125556.1| Arabidopsis thaliana transcription factor (AT5G61620) mRNA, complete cds
ATGGTGAAGGAGACGGTGACGGTGGCGAAAACGTGCTCACACTGTGGCCATAATGGCCATAACGCA
CGGACTTGTCTCAACGGCGTTAATAAGGCAAGTGTTAAACTGTTCGGCGTTAATATATCGTCTGAT
CCGATTAGGCCGCCTGAGGTAACGGCGTTAAGGAAGAGTCTTAGTTTGGGAAACCTTGATGCTCTT
CTCGCTAACGATGAAAGTAACGGTAGCGGTGATCCTATCGCCGCCGTTGATGATACCGGTTATCAT
TCCGATGGTCAGATTCATTCCAAGAAGGGTAAAACTGCTCATGAGAAGAAAAGGGGAAGCCATGG
ACGGAAGAAGAACATCGTAATTTCTTAATCGGTTTAAACAAACTCGGAAAAGGAGATTGGAGAGGC
ATTGCAAAGAGTTTCGTGTCGACAAGAACACCAACACAAGTCGCAAGTCATGCTCAGAAATATTTT
ATTAGGTTAAACGTTAACGACAAGAGAAAAGACGTGCTAGTCTCTTTGACATCTCTCTCGAAGAT
CAGAAGGAGAAAGAGAGGAACTCTCAAGATGCTTCAACAAAGACTCCACCTAAACAACCAATAACC
GGAATTCAACAACCGGTAGTACAAGGTCATACTCAAACCGAGATTTCGAACAGGTTTCAGAATTTA

```
TCAATGGAGTATATGCCAATCTACCAACCCATACCACCTTACTACAACTTTCCACCTATTATGTAC
CATCCAAATTATCCAATGTACTATGCCAACCCTCAAGTACCGGTTAGGTTTGTTCATCCTTCTGGT
ATACCTGTTCCAAGACATATACCGATTGGTTTGCCTCTGTCTCAACCGAGTGAAGCTTCTAATATG
ACAAATAAAGACGGTTTGGATCTTCATATCGGTTTGCCTCCACAAGCTACTGGAGCTTCTGACTTG
ACTGGTCATGGCGTTATTCATGTGAAATGA
```

SEQ ID NO: 40, NP_200970.1, transcription factor (AT5G61620) [Arabidopsis thaliana]
```
MVKETVTVAKTCSHCGHNGHNARTCLNGVNKASVKLFGVNISSDPIRPPEVTALRKSLSLGNLDAL
LANDESNGSGDPIAAVDDTGYHSDGQIHSKKGKTAHEKKKGKPWTEEEHRNFLIGLNKLGKGDWRG
IAKSFVSTRTPTQVASHAQKYFIRLNVNDKRKRRASLFDISLEDQKEKERNSQDASTKTPPKQPIT
GIQQPVVQGHTQTEISNRFQNLSMEYMPIYQPIPPYYNFPPIMYHPNYPMYYANPQVPVRFVHPSG
IPVPRHIPIGLPLSQPSEASNMTNKDGLDLHIGLPPQATGASDLTGHGVIHVK
```

SEQ ID NO: 41, myb-like DNA-binding domain, SHAQKYF class family protein, LOC_Os01g06320 coding sequence
```
ATGGATAGGAACACGAACAACAACAGCAACAGCAGCAGCAGCAGCGAGATGCCGGGGAAGAAGGCC
AGGAAGCCGTACACCATCACGAAGCCACGGGAGAGATGGAGCGAGGAGGAGCACGAGAGGTTCCTC
GACGCGCTCATCATGTACGGCCGCGACTGGAAGAAGATCGAGGAGCACGTCGGCACCAAGACCACC
ATACAGATCCGCAGCCACGCGCAGAAGTACTTCCTCAAGGTGCAGAAGATGGGGCTCGCCGCCGGG
CTGCCGCCGCAGTACCCGAGGCGGAGGCTCGTCATGCAGCAGCAGCAGCAGCAGAGCTCGCCGGCG
GTGAGCAGCTCGGTGGCGGCGACGGCGATCCTCCACGGGCAGCCGCAGTGCTTGCCGCCGCATCAC
AACGTCGCTGTTCAGAGCTCCATCGGTTGGGAGTGTCCCGGAGTTCTTCCTCCTGCAACCAATGAC
ATGCAGAACTTGGAATGGGCAAGTACTTCAGGCACTGCAGCCTGGGGGAACCATCACGGCCTGATT
GAACCACCAGCAGCATTTGTTTCATTTCCTGGTGAAAGTTCATTCATGGGGGCAGCAAGTTTCAGT
AATACGAGCATGGACTGGACTGGCACCACAAGTGAAATGGCAACAGCCAGCATTGTGCAGGATGAA
ACGATCGAGCTTCCACTATCACCTGATGATCTGCAATTTGCACAAGTATACAGGTTCATCGGCGAC
ATTTTCGATCCAGACTCGCCGTGTCCAGTGGAAACACACCTTCAGAAACTGAAGAGCATGGATGAT
ATCATCGTGAAGACGATACTGTTGGTGCTAAGAAATCTCGAAGACAACCTGTTATCCCCTCAGTTT
GAGCCTATTAGAAGGTTGCTGTCGACGTATGATCCGAACCGAGGACTGTCTGGCCATTTGTAG
```

SEQ ID NO: 42, myb-like DNA-binding domain, SHAQKYF class family protein, LOC_Os01g06320
```
MDRNTNNNSNSSSSSEMPGKKARKPYTITKPRERWSEEEHERFLDALIMYGRDWKKIEEHVGTKTT
IQIRSHAQKYFLKVQKMGLAAGLPPQYPRRRLVMQQQQQQSSPAVSSSVAATAILHGQPQCLPPHH
NVAVQSSIGWECPGVLPPATNDMQNLEWASTSGTAAWGNHHGLIEPPAAFVSFPGESSFMGAASFS
NTSMDWTGTTSEMATASIVQDETIELPLSPDDLQFAQVYRFIGDIFDPDSPCPVETHLQKLKSMDD
IIVKTILLVLRNLEDNLLSPQFEPIRRLLSTYDPNRGLSGHL
```

SEQ ID NO: 43, myb-like DNA-binding domain, SHAQKYF class family protein, LOC_Os01g09280, coding sequence
```
ATGACGAGGCGGTGCTCGCACTGCAGCAACAACGGCCACAACGCGCGGACCTGCCCCGCCCGCGGC
GGCGGTGGAGGCGGAGGCGGGGTGAGGCTGTTCGGCGTGCGGCTCACGTCGCCGCCGGAGGTGGCG
ATGAAGAAGAGCGCGAGCATGAGCTGCATCGCGTCGTCGCTCGGGAGTGGCGGTGGGTCAGGGGGT
TCGTCGCCGGCGGGAACGGGAAGGGAGGAGGAGGAGGGGGAGAGGGCGCGGCCGGGTACGCGTCC
GACGACCCCACGCACGCCTCCTGCTCGACGAATGGCCGCGGCGAGCGGAAGAAAGGTACACCTTGG
ACTGAAGAAGAGCATAGAATGTTTCTAATGGGTCTGCAGAAGCTTGGTAAAGGAGACTGGCGTGGG
```

FIGURE 4 (continued)

```
ATCTCTCGTAATTTTGTTGTTTCCAGGACACCAACTCAGGTGGCTAGCCATGCTCAAAAGTACTTC
ATTAGACAGACAAACTCATCAAGAAGGAAGAGGAGGTCAAGCTTGTTTGACATGGTCCCAGAAATG
CCCATGGACGAATCCCCAGTGGTCGTAGAACAGCTTATGCTCCATAGTACTCAAGACGAAGCCACA
AGCTCAAATCAATTGCCAATATCACATCTTGTGAAACAGAAGGAACCTGAGTTTGCTAGACACCTG
TCGGATTTGCAGCTAAGGAAGCATGAGGAATCTGAGTTCACAGAACCTTCACTAGCAGCACTAGAC
TTGGAGATGAACCATGCTGCACCTTTCAAGACTAAATTGTTCTGACAATGCCAACATTCTACCCG
GCATTAATACCTGTTCCACTAACTCTTTGGCCTCCAAATGTTGCTAATGTGGGTGAATCAGGCACA
AATCATGAAATCCTAAAGCCCACTCCAGTGAATGGAAAGGAGGTGATCAATAAGGCTGATGAGGTT
GTTGGCATGTCCAAGCTTACCATAGGTGACGGCAGCTCTAACTCCATAGAACCCTCTGCTCTTTCC
CTTCAGCTTACTGGACCGACAAATACAAGACAATCAGCTTTTCATGTGAACCCACCAATGGCTGGA
CCTGACCTAAATAAGAGAAACAACAGCCCAATTCATGCAGTTTGA

SEQ ID NO: 44, myb-like DNA-binding domain, SHAQKYF class family
protein, LOC_Os01g09280
MTRRCSHCSNNGHNARTCPARGGGGGGGGVRLFGVRLTSPPEVAMKKSASMSCIASSLGSGGGSGG
SSPAGTGRGGGGGGEGAAGYASDDPTHASCSTNGRGERKKGTPWTEEEHRMFLMGLQKLGKGDWRG
ISRNFVVSRTPTQVASHAQKYFIRQTNSSRRKRRSSLFDMVPEMPMDESPVVVEQLMLHSTQDEAT
SSNQLPISHLVKQKEPEFARHLSDLQLRKHEESEFTEPSLAALDLEMNHAAPFKTKFVLTMPTFYP
ALIPVPLTLWPPNVANVGESGTNHEILKPTPVNGKEVINKADEVVGMSKLTIGDGSSNSIEPSALS
LQLTGPTNTRQSAFHVNPPMAGPDLNKRNNSPIHAV SEQ ID NO: 45, myb-like DNA-binding domain, SHAQKYF class family
protein, LOC_Os01g09640, coding sequence
ATGGCCAGGAAATGCTCCAGCTGCGGGAACAATGGCCACAACTCCAGGACTTGCACCGGCCAAAGG
AGCCTGCAGGAGAGTGGCGGCGGTTATGGCGGCGGTGGCGCCGGTGGCGTGAGGTTGTTCGGGGTG
CAGTTGCACGTCGGCGGTGCGCCTCTGAAGAAGTGCTTCAGCATGGAGTGCCTATCGTCGCCGTCG
CCGTCGCCGTCGCCGGCGTACTACGCCGCGGTCGCCGCCGCCGCCTCCAACTCGTCGCCGACCGTG
TCGTCGTCGTCGCTGGTGTCGGTGGAGGAGGCCGGCGAGAAGATGGCCAACGGGTACCTCTCC
GATGGCCTCATGGCGAGAGCTCAGGAGAGGAAGAAGGGTGTTCCATGGACTGAAGAGGAGCACAGG
AAATTCCTGGTAGGGCTCGAGAAGCTCGGGAAAGGCGACTGGCGCGGCATTTCCCGGCACTTCGTC
ACGACAAGAACACCGACGCAGGTGGCCAGCCATGCCCAGAAGTATTTCCTCAGGCAGAGCAGCCTC
ACGCAGAAGAAGAGAAGATCCAGCCTCTTTGACGTGATTGAGGATGCAGAAAAGGCTCCGAGTGTG
AATGAACGTCTGAAACTGAGACACGAGACAGCCTCTGTGCCTGCTGAAATGGGATTCCCTGCACTG
TCACTGGGTATCAGCAGCATGGCACAGCCAGAAGCCATGCTGCTGCCTCCTCCATCCTTAACCCTG
ACGCCAAGCTGTTCATCACCAGCAGTGAGCAGCAGCAGCAGCGAACAACCAAGAACAATCCATCCT
TCTCTGATGGTGGCAAAGCCTCAGGTGCAACTGCAACTCCAGCCACCTGATCTGGAGCTCAAGATC
TCGACTGTCCGTCAGAACGATCAGCCCAGTTCGTCGCCGAGGACGCCTTTTTGGGGACAATCAGG
GTCACTTGA SEQ ID NO: 46, myb-like DNA-binding domain, SHAQKYF class family
protein, LOC_Os01g09640
MARKCSSCGNNGHNSRTCTGQRSLQESGGGYGGGAGGVRLFGVQLHVGGAPLKKCFSMECLSSPS
PSPSPAYYAAVAAAASNSSPTVSSSSSLVSVEEAGEKMANGYLSDGLMARAQERKKGVPWTEEEHR
KFLVGLEKLGKGDWRGISRHFVTTRTPTQVASHAQKYFLRQSSLTQKKRRSSLFDVIEDAEKAPSV
NERLKLRHETASVPAEMGFPALSLGISSMAQPEAMLLPPPSLTLTPSCSSPAVSSSSSEQPRTIHP
SLMVAKPQVQLQLQPPDLELKISTVRQNDQPSSSPRTPFLGTIRVT
```

FIGURE 4 (continued)

SEQ ID NO: 47, MCB2 protein, putative, LOC_Os01g41900, coding sequence
ATGGCGAGGAAGTGCTCCTACTGTGGCAACTACGGCCACAACTCAAGAACCTGCAGCAGCAGCGCC
AGCGCTGGACACAGGGATACCACCATGCTCTGCGACGGCGGCGACGGAGGTGGCGGCAGTGGGCTG
AGGCTGTTCGGAGTGCAGGTCCATGTCGCTGCCGGCGGCGGCGGTGGAGGTGGAGGTGGAGGTTTG
CCGATGAAGAAGAGCTACAGCATGGACTGCCTGCAGCTGGCGGCGGCGGGGGCGGCTCCGGGCTCG
CTCGTGTCGCCGTCGTCGTCGTCCTCGTCGTCGATGCTCCTGTCGATCGACGAGGGGGGCTTGGAG
AGGGCGTCCAATGGGTACCTGTCTGATGGCCCCCATGGCAGAATTGTCCAGGAGAGGAAGAAAGGA
GTTCCGTGGAGCGAGGAGGAGCACCGGCTGTTCCTCGTCGGGCTCGAGAAGCTGGGCAAGGGCGAC
TGGCGAGGCATCTCCCGGAGCTACGTCACGACGAGGACCCCGACCCAGGTCGCCAGCCACGCCCAG
AAGTTCTTCCTCAGGCAGAGCAGCATCGGCAAGAAGAAGCGCCGCTCCAGCCTCTTCGACATGGTG
CCGATTTGCGAGAACGGTGCGCGCGTCTCGGAGCAGCTGAGCGGCGAAGGCGCGGCGGCGGCGGCG
GCGGCGTCGACCTCACTGTCGCTGATGAACACGCACGAGACCTCCTCGGACAGAGTGGCGGCAATT
GATCTGAATTCCACCGAGGAAGATGACACGGTGGGCGCGTCAGGGAGGCCGTTTTTCCCGGTGGTT
CTGATGGAGCAGCAGCAGCAGGCTTCCCATGGACATGGTCACCACCACCACTGCACGCCGCTCGAC
CTGGAGCTCGGCATGTCCGTCTCGTCGACGCCGTCCATCGGCACATGA

SEQ ID NO: 48, MCB2 protein, putative, LOC_Os01g41900
MARKCSYCGNYGHNSRTCSSSASAGHRDTTMLCDGGDGGGGSGLRLFGVQVHVAAGGGGGGGGGGL
PMKKSYSMDCLQLAAAGAAPGSLVSPSSSSSSSMLLSIDEGGLERASNGYLSDGPHGRIVQERKKG
VPWSEEEHRLFLVGLEKLGKGDWRGISRSYVTTRTPTQVASHAQKFFLRQSSIGKKKRRSSLFDMV
PICENGARVSEQLSGEGAAAAAAASTSLSLMNTHETSSDRVAAIDLNSTEEDDTVGASGRPFFPVV
LMEQQQQASHGHGHHHHCTPLDLELGMSVSSTPSIGT

SEQ ID NO: 49, Myb-like DNA-binding domain containing protein, LOC_Os02g30700, coding sequence
ATGCCTACAGATGATGCCACGGCGACGGGCAACGGCGACGGCGCCGCTCCCGTCCGGCAGCCGCC
GAGCCAGCGGCGCCGCTGTCGTCCGTGTGGACGCGGCGGGACGAAAAGCTGCTGGAGATGCTGCTC
TGGCGCTGGCAGCTGGACCCGCACTGGGACCGGCTCGCCGCGGAGCTCGGCGGCAAGACGGCGACG
CAGGTGTTCGACCGGTACGTGTGCTTGGCCGACGAGCTGAGGCTCGTCATGGCGGCGCCGGCGGTG
GACACGCCGCCCGCGTGGGACGTGCAGGACGAACGGGAGGCCGCTGTGGCGCCACTACCCGGGTTG
GAGGCCGACGCGGCGGCCGGCGCCGGAGAGTCAGCGGAGGTGACGGCCATTGGCATCGCTGCCGCC
GCTTCTCCGAATGCAGCTGCTACGAGCGCTCCGACCATCGGCGGCGGGGTGGTATTGAAATCTAGA
GAGCTGAAAAATCCGCGGAAGACGAGGATGGCCGGCGGCGGGCCAAGGAAGAAGGCGGAGATGTGG
ACCAGGGAAGAGCATAGCCAATTCTTGCACGGGATTAGTACGTACGGGAAGGGGAATTGGAAGGCG
CTGGCGAGCGAGTTCGTGAAGACCAAGAGCTCGACCCAGATCGCGAGCCACTACCAGAAGTTCTGC
ATCAGGGAAGAGAAGAGGAGGCTGAGCAAGTGCAAGCGGGCGAGCATCCACGACATCGTCAGCCCG
ACGACGACGACGTCCGCGCCTGAATCTGCCGGCGCCGGCCCGAGTGCACCACCGTGCGCGCTGATC
GAAAGCGGTGCGCTGATTGCAGGCGACGATGACGCATGA

SEQ ID NO: 50, Myb-like DNA-binding domain containing protein, LOC_Os02g30700
MPTDDATATGNGDGAAPRPAAAEPAAPLSSVWTRRDEKLLEMLLWRWQLDPHWDRLAAELGGKTAT
QVFDRYVCLADELRLVMAAPAVDTPPAWDVQDEREAAVAPLPGLEADAAAGAGESAEVTAIGIAAA
ASPNAAATSAPTIGGGVVLKSRELKNPRKTRMAGGGPRKKAEMWTREEHSQFLHGISTYGKGNWKA
LASEFVKTKSSTQIASHYQKFCIREEKRRLSKCKRASIHDIVSPTTTTSAPESAGAGPSAPPCALI
ESGALIAGDDDA

FIGURE 4 (continued)

SEQ ID NO: 51, myb-like DNA-binding domain, SHAQKYF class family protein, LOC_Os05g07010, coding sequence
ATGGCGGCAATGGCGGCGGCGGCGGGGACGAAGAAGAAGGCGAGGAAGCCGTACACGATCACG
AGGCCGCGGGAGAGGTGGTCCGCCGAGGAGCACGAGCGCTTCCTTGACGCCCTGATTCTGTTCGGC
CGTGACTGGAAGAGGATCGAAGCGTTCGTCGCCACCAAGACGGCCATCCAGATTCGCAGCCATGCC
CAGAAGCATTTTCTGAAGGCCCGCAAGTTCGGCCTCGCCGGTGGGCTCCCGCCGCCGCTTCACCCT
CGCCGTGCCACGCTGCTCCGGGCCAACGCCGCGGCGGCGGACATGATGCCGCCCCGTGGCTGCCA
TCGGCCGGCGGCGGCTCCATCGGTTGCTCGGCGCCACCGTCCGGCGTGCAGCAGAGCATGGCCGGC
AGGTCGCCGGCGTGCTACTCAACTGATGAAGCTTCTTTCCGGCCATTGATTCATAGCAATGACAAT
GACTGTTCATTCATCGAGACACCAAGCTGCATCGGATCAGGTGGCGAATCATGGATCGGTGATGAT
GCCTTCTTCATGCAGGATGAAACAATTCGGCTCCCAATTTCTCCAGATGACCTGGGATTCGCTCAG
GTGTACAAGTTCGTCGGCGACATGTTCGGCTCCGGCGAGCGGCGGCCGGTGGAGGCTCACCTGCGG
AGGCTGCAGGGCATGGACCCTGCCATCTCGGAGACGATCTTGCTGGTGCTTAAGAATCTCGAAGCT
AATCTATCTGCTTAA

SEQ ID NO: 52, myb-like DNA-binding domain, SHAQKYF class family protein, LOC_Os05g07010
MAAMAAAAGTKKKARKPYTITRPRERWSAEEHERFLDALILFGRDWKRIEAFVATKTAIQIRSHA
QKHFLKARKFGLAGGLPPPLHPRRATLLRANAAAADMMPPPWLPSAGGGSIGCSAPPSGVQQSMAG
RSPACYSTDEASFRPLIHSNDNDCSFIETPSCIGSGGESWIGDDAFFMQDETIRLPISPDDLGFAQ
VYKFVGDMFGSGERRPVEAHLRRLQGMDPAISETILLVLKNLEANLSA

SEQ ID NO: 53, myb-like DNA-binding domain, SHAQKYF class family protein, LOC_Os05g10690, coding sequence
ATGGCTAGGAAGTGCTCTAGCTGTGGGAACAATGGCCACAACTCCAGGACTTGCAGTGGCCAAAGA
GTTCTTGATCACAGCATCAGCAGCAGCAACAGTGGTAGTACTACTGCTGCTGCTGCTACTGCCTGT
GGTGGCTTGAGGTTGTTTGGGGTGCAGCTGCAGGTAGGAGGAGGCTCATCTCCTCTGAAGAAGTGC
CTCAGCATGGAGTGCTTGGCATCACCAGCATACTATGGAGCTTCTGCCTCGCCGTCGGTTTCGTCG
TCGTCATCTTCGCTTGTTTCGATTGAGGAGAACACTGAGAGGGTCTCCAATGGGTACCTCTCTGAT
GGGCTCATGGGAAGGGTTCAGGAGAGGAAGAAAGGAGTTCCATGGACTGAGGAAGAACACCAGATG
TTCCTCGCCGGCCTTGACAAGCTCGGAAAAGGCGACTGGCGGGGCATTTCTCGGCACTTCGTCACT
ACCCGGACTCCAACGCAGGTCGCCAGCCATGCCCAGAAGTACTTCCTGAGGCAGAACAGTATGACA
CAGAAGAAGAGGAGGTCCAGCCTCTTTGATGTGGTTGAAGGTATCAAGAGGGCAGCAGCAATGCCC
ATTTCAGGATCTGCATCTGAACTGCAGATCCCCGGCATGTCGATCGGTGTCGGCGTGGTGAAGGAG
GAGGTTGTCCTGCCTCCATGTCTGAACCTGATGAGTAACAGTTCATCAGCATCACAGCACTCACCT
TCCCTGACATTGCTGGCAAATCCTCAGGTGCAGCTCCAGATGCCTGACCTGGAGCTAAAGATGTCC
ACATCCCGGTTATCTGACCAATCCGGTCCGTCGCCGAGCACGCCTTCTTCGGGACCATCAGAGTT
ACCTGA

SEQ ID NO: 54, myb-like DNA-binding domain, SHAQKYF class family protein, LOC_Os05g10690
MARKCSSCGNNGHNSRTCSGQRVLDHSISSSNSGSTTAAAATACGGLRLFGVQLQVGGGSSPLKKC
LSMECLASPAYYGASASPSVSSSSSSLVSIEENTERVSNGYLSDGLMGRVQERKKGVPWTEEEHQM
FLAGLDKLGKGDWRGISRHFVTTRTPTQVASHAQKYFLRQNSMTQKKRRSSLFDVVEGIKRAAAMP
ISGSASELQIPGMSIGVGVVKEEVVLPPCLNLMSNSSSASQHSPSLTLLANPQVQLQMPDLELKMS
TSRLSDQSGPSPSTPFFGTIRVT

FIGURE 4 (continued)

SEQ ID NO: 55, MCB2 protein, putative, LOC_Os05g51160, coding sequence
ATGCACGCCATCATGGCGAGGCGATGCTCTGGTGACTACTCGACTGCAGGCCAACGAGCCGGCGAG
GAGGGCGGCGGCGGCGGCGGCGCCGGGCTACGGCTGTTCGGGGTGCAGCTCCATGCTGCGGCGGCC
AGCTCGCCGGCGTCCTACTTGCACAAGAGTTACAGCATGGATTGCCTGCGGCTGCAGGTTTCTTCT
CCTTCCTCCTTGCAGTCGTCGTCGTCGTCGCCGTCGCCGTTGACGTCCTCGTTGTTGCTGTCCATC
GACGAGGGCTGCGAGAGGCCAGCCGCCGACGGCTACCTCTCCGACGGGCCTCACGGCGCGGCGGCA
ACCATGCGGGAGAGGAAGAAAGGAGTTCCATGGAGCGAGCAAGAGCACAGGCTGTTCCTGGCGGGG
CTGGAGAAGCTGGGCAAGGGCGACTGGCGAGGCATCTCCCGGAGCTTCGTCACCACCAGGACGCCC
ACCCAGGTCGCCAGCCATGCCCAGAAGTTCTTCCTCCGCCACAACAGCGCCGCCAAGAAGACCAAC
AACAAGCGCCGCTCCAGCCTCTTCGACATGGTTCAGGATTGTGACAGTGGAGGAAGATCTCTCGCC
TCATCCGATCCTGCCACTCGCTGCAACAACAACATCTCTGCTTCTCTGTCTCTCCAAGTTTCGCAC
CACAAATCAGGTGACAGTGCGTGGCCTTCGTCAGAAACACCATCAGTTTCAGAAGCACAACAAGGT
CATGGATACGGCACTAGTCACCATTGCTCTCCGCTGGACCTGGAGCTGGGCATGTCCCTGTCCACC
ACGCCATCCATCGGAACCTAG

SEQ ID NO: 56, MCB2 protein, putative, LOC_Os05g51160
MHAIMARRCSGDYSTAGQRAGEEGGGGGGAGLRLFGVQLHAAAASSPASYLHKSYSMDCLRLQVSS
PSSLQSSSSSPSPLTSSLLLSIDEGCERPAADGYLSDGPHGAAATMRERKKGVPWSEQEHRLFLAG
LEKLGKGDWRGISRSFVTTRTPTQVASHAQKFFLRHNSAAKKTNNKRRSSLFDMVQDCDSGGRSLA
SSDPATRCNNNISASLSLQVSHHKSGDSAWPSSETPSVSEAQQGHGYGTSHHCSPLDLELGMSLST
TPSIGT

SEQ ID NO: 57, myb-like DNA-binding domain, SHAQKYF class family protein, LOC_Os06g07640, coding sequence
ATGGGTTCAATAGTCATTGAGGGGTGGACGGCATCTGAGATAGAGGAGGCTAGGTCACTGATCACT
AGCCCCAACAACGGTGGCGAAGGTGGTGATGGAGAGGGGAACAAGCAGAAGCATTGCGGACACATC
GTGATGGAACTCCATGAATGGTTCCCTTGGAAGACCATAGGCCAGGTAATAGGTTTGTATATGAAG
CTCAATGCGGGGAAACCCATGGTTATGCATAGCTTGAATAAGAGTGATGCCAACAATAGCATCGGT
GAGGTTGATCATGTGAGTGCCCTCGCAAACGGTAACCCTGTGAGGCTAGAGGAACATCGACCCATG
TTGAACAATGTGGGCTTAGTGTTTGATTATCCATTGGAAGAGATGGAGATGGAAAATCAAACAGAT
CAAGAGCCGAAGATGGTTGTAGAGGAGGAGGTGCAGCCTAAGGAGGGATTAGTGATCAAGGAGAAA
GAGGCGGGGGTGTCAAAGATTCACACTAATAGTCAACATGTGACGCCATCAATAAAAAGAAGGGTG
ATTTGGACAGAGGAAGAACACAGGCTGTTCATGGTGGGCTGCGCGTGTTCGGGCGCGGCGACTGG
AAGAACATCTCCAAGCACCTTGTCACCACCAGGACGGCGGCGCAGGTCTCCAGCCACGCGCAGAAG
TTCTTCCTCAAGATGGAGGCCCGCGGCGAGGCCGTCCCCCGCCGGCCAAGAGGCGCCGCCGCCGC
ATCACCGGCGACCAGCAGGCGGCGGCCGCCGAGCACGCTGCCGCCCTCAGGCGCCGCATGCCAGTG
CCACCGCCTCCGTTCAACCCCTTCCTCCTGCCCAGCCTCGTCGCGCCGGTGATGCACCGCCTCCTC
CCACCTGGGAGCCAGGCTGCCGGCGCCGCCGCCTCCGGCAGCGGCGGCCAGGGAGCTTCTCTTCCT
CAGATGCCATGGATCAACGGCGCCAATGGCATGGGGCGCTAG

SEQ ID NO: 58, myb-like DNA-binding domain, SHAQKYF class family protein, LOC_Os06g07640
MGSIVIEGWTASEIEEARSLITSPNNGGEGGDGEGNKQKHCGHIVMELHEWFPWKTIGQVIGLYMK
LNAGKPMVMHSLNKSDANNSIGEVDHVSALANGNPVRLEEHRPMLNNVGLVFDYPLEEMEMENQTD
QEPKMVVEEEVQPKEGLVIKEKEAGVSKIHTNSQHVTPSIKRRVIWTEEEHRLFMVGLRVFGRGDW
KNISKHLVTTRTAAQVSSHAQKFFLKMEARGEAVPPPAKRRRRRITGDQQAAAAEHAAALRRRMPV
PPPPFNPFLLPSLVAPVMHRLLPPGSQAAGAAASGSGGQGASLPQMPWINGANGMGR

FIGURE 4 (continued)

SEQ ID NO: 59, myb-like DNA-binding domain, SHAQKYF class family protein, LOC_Os06g07650, coding sequence
ATGGAGTGGACGGCGGCGGAGATGGACGAGGCGAGGTCGATCATCGCTAGGCTGACCAACGCTTAC
GACTCCGGCACCCTCGTTGCCGGCGCCGGCAACGGCGACACGAGGCACGACCGCATTGTGAGGGAG
CTGCAGGCGTGGCTCCCATGGAGGACCATGGATCAGCTAATCGGGCTGTACATTGAGCTCATGGCG
GAGGAGCCCGCGGCGGCGCAGCCGCAGTACTTCGACGCCGGCGCCGTCGTCGACCCTACGTTCGAC
TTCTTCAACGACCACAACAACTTCCTCGGCATGCCGCCGCCGCCGGTTCAACAAGCTGATGACCAT
AACATGAACAACGTCGTCGCCGACGCCGGCATGAACTACTACTATGGCGGCGGCGGCGCCGGCGGT
GCCATGGTGTTTGGTGGTGCACCCATGGGGGAGACGGTGGAGCAGGCAGCTCCGCCGGTGCCGGTG
GTGCCGGTGGTGATGAACCGCGACGACGACGAGGTGAACAACCAGGGCGGCGGCCGTCACCGTGCT
GCACCAACAAATACTACTAGGAGGTTTTGGACCACTGAAGAGCACAGGCAGTTTCTGAGGGGGCTG
CGTGTGTACGGACGTGGTGAGTGGAAGAGCATCTCCATGAACTTCGTCAGAAGCAAGACGCCGGTG
CAGGTGTCCAGCCACGCCCAGAAGTACTTCCGCCGCGTGGAGAGCGCCGCCGCCGACAAGCAGCGC
TACAGCATCAACGACGTCGGCCTCAACGACGACACCGCCGCCATGGACGGCACCAACAGCTACAGC
AACAATAACTTCGGTGGCTGGCAGAGTCTCGCCTTCGCCGGCGGCCACCTCGAGCCCGTCAGCGGC
GGCGGCGCCGCCAGGCAAGTCATCGCTCCGGCGAGCTCCTCCGCCGCTGCCATGAACAGCGCCGCT
CAGTTCTGGGCTCCTATGCTGTTCAACCCCCAGATTCAGCAGCAGTTCATGCAGATGCAGGCGCAG
ACGCAGCAGGCGTGGAATGATCAGCATATGATGATGGCTGCTGCTCCAATGGAGGGAGCAACTGAT
ACTAACTTTGAGCCTGCAGGTGCAGTTAATTATTATTATTATCAACAGCAGCAGGAGGAGGAGGAG
GGAGGTGCTTATGGTGTTCCTGCGGATCAGTGGATGATGAACCAGAACAACAACATGTGCTGA

SEQ ID NO: 60, myb-like DNA-binding domain, SHAQKYF class family protein, LOC_Os06g07650
MEWTAAEMDEARSIIARLTNAYDSGTLVAGAGNGDTRHDRIVRELQAWLPWRTMDQLIGLYIELMA
EEPAAAQPQYFDAGAVVDPTFDFFNDHNNFLGMPPPPVQQADDHNMNNVVADAGMNYYYGGGGAGG
AMVFGGAPMGETVEQAAPPVPVVPVVMNRDDDEVNNQGGGRHRAAPTNTTRRFWTTEEHRQFLRGL
RVYGRGEWKSISMNFVRSKTPVQVSSHAQKYFRRVESAAADKQRYSINDVGLNDDTAAMDGTNSYS
NNNFGGWQSLAFAGGHLEPVSGGGAARQVIAPASSSAAAMNSAAQFWAPMLFNPQIQQQFMQMQAQ
TQQAWNDQHMMMAAAPMEGATDTNFEPAGAVNYYYYQQQQEEEEGGAYGVPADQWMMNQNNNMC

SEQ ID NO: 61, hypothetical protein, LOC_Os06g07700, coding sequence
ATGGAGTGGACGGCGGCAGAGCTGGCGGAGGCAAGGTCGGTCATCGCTAGGGTCAGCGACGCCTAC
AACTCCGGCGTAGGCAGCAGCAGCAGCGCCTGCGACACCAAGCACGACCGCATTATGAGGGAGCTC
CAGGCGAGGTTCCCGTCGAGGACCATGGTCCAGGTAATCGATCTGTACGTTAATCTCACGGTGGAG
ACGGCGGCGCAGCCGCAGGACGCCGGCAGCGCCGGCGACGCCGCCGCCGTCGTCCACCCTACTTTT
GCCGGCGGCATGCCCGTTGTGAACAACAACGACGGCATGGTGCATGGTGGTGCTGCTATGGAGGTG
GGGGCGGTGGCGGTGAACGGCGGGGACGGTGAGGTGGTGAACCCGGACAATGCTGATGACGATGTG
CTTTGGACTGATTATGAGCACAGGCTGTTTCTGACTGGGATGCGTGTGTACGGCGTGGCGACTGG
AGAAACATCTCGAGGTACTTCGTCAGAAGCAAGACGCCGGAGCAGATCTCCATGTACGCCGACAAC
TACTTCCACATGATGGAGATCGCCGCGGCCATGGAAGCCGACGGCGGCGACGACGACGACGGCCAC
CATGAAATCAATAACAACAACAACAACTTGGGCGGCGGCCAGCTGCACGCCGTCGTCGGCGCCGTC
GGGCACGGCCCCGGTGCCGGGCACATTGCTCCGGCGACCCCTCCAACAACAACACCGCCGCCGCC
GCCGTGAACAACAACGTCGACACACCGTTCTGGGTTCCGCTGCTGTACAACCCCGAGATAGAGCAG
CGGATGATGGAGATGCAGGCGCAGTCGCAGAAGGCCTGGGATGATCAGCAGATGAAGATGGCTGAA
GCTGCAACTCCAAAGGAGGAGGGAGCAGCTGATAAGTGA FIGURE 4 (continued)

SEQ ID NO: 62, hypothetical protein, LOC_Os06g07700
MEWTAAELAEARSVIARVSDAYNSGVGSSSSACDTKHDRIMRELQARFPSRTMVQVIDLYVNLTVE
TAAQPQDAGSAGDAAAVVHPTFAGGMPVVNNNDGMVHGGAAMEVGAVAVNGGDGEVVNPDNADDDV
LWTDYEHRLFLTGMRVYGRGDWRNISRYFVRSKTPEQISMYADNYFHMMEIAAAMEADGGDDDDGH
HEINNNNNNLGGGQLHAVVGAVGHGPGAGHIAPATPSNNNTAAAAVNNNVDTPFWVPLLYNPEIEQ
RMMEMQAQSQKAWDDQQMKMAEAATPKEEGAADK

SEQ ID NO: 63, myb-like DNA-binding domain, SHAQKYF class family protein, LOC_Os06g07740, coding sequence
ATGCTGCTCTCTCATTGTTTTGCAGTAGCATTCGCTCTCTCTGCGCTGCTCGCCGGCCTCGCCCTC
GCCATGGACGACGCAACGTTCGGCATGGAGTGGACGGCGGCGGAGCTGGGTGAGGCGAGGTCGGTC
ATCGCTAGGGTCAGCAACGCCTACGACTCCGGCGCCGGCAGCAGCAACAGTGCCGGCGACACCAAG
CACGACCGCATTATGAGGGAGCTCCAGGCGAGGTTCCCGTCGAGGACCATGGTCCAGGTAATCGAC
TTGTACCTTAATCTCACGGCGGAGACAGCAGCGCAGGCGGGGGCGGCCCAGCCGCAGGACGCCGGC
GGCGCCGGCGACGCCGCCGTCGTCCACCCTACCTTTGGCCTCGCAACGACAACTTCGGCATGCCC
GTTGCGAACAACAACGACGACGGCGTCGACGCCGGCATGGTGTTTGGTGGAGCTCCTATGGAGGAG
GGGGCGGTGGCGGTGAACGGTGGGGACGGTGAGGTGGTGAACCCGGACAATGCTGATGACGATGTG
CTTTGGACCGATTATGAGCACAGGCTGTTCCTGACTGGGATGCGTGTGTACGGGCGTGGCGACTGG
AGAAACATCGCGAGGTACTTCGTCGGAAGCAAGACGCCGGAGCAGGTCTCCATGTACGCCGATAAC
TACTTCCACATGATGGAGATCGCCGCGGCCATGGAAGCCGACGGCGACGACGATGACGACCACCAT
GAAAACAATAACAACAACTTGGGCGGCGGGCAGCTGCACGCCGTCGTCGGCGCCGTCGAGCACCAT
GAAAATTACAACAACAACAACTTAGGCGGCGGGCAGCTGAACGCCGGCCTCGGCGCCGTCGGGCAC
GGCCCCGGTGCCGGGCACATTGCTCCGGCGACCTCCTCCAACAACAACGTCGCCGCCGCCGCCGCG
AACAACAACGTCGACGCACCGTTCTGGGTTCCGCTGCTGTACAACCTCGAGATAGAGCAGCGCATG
ATGGAGATGCAGGCGCAGTCGCAGAAGGCCTGGGATGATCAGCAGATGAAGATGGCTGAAGCTGCA
ACTGATCCAAAGGAGGGAGCAGCTGATAAGTGA

SEQ ID NO: 64, myb-like DNA-binding domain, SHAQKYF class family protein, LOC_Os06g07740
MLLSHCFAVAFALSALLAGLALAMDDATFGMEWTAAELGEARSVIARVSNAYDSGAGSSNSAGDTK
HDRIMRELQARFPSRTMVQVIDLYLNLTAETAAQAGAAQPQDAGGAGDAAVVHPTFGLANDNFGMP
VANNNDDGVDAGMVFGGAPMEEGAVAVNGGDGEVVNPDNADDDVLWTDYEHRLFLTGMRVYGRGDW
RNIARYFVGSKTPEQVSMYADNYFHMMEIAAAMEADGDDDDDHHENNNNNLGGGQLHAVVGAVEHH
ENYNNNNLGGGQLNAGLGAVGHGPGAGHIAPATSSNNNVAAAAANNNVDAPFWVPLLYNLEIEQRM
MEMQAQSQKAWDDQQMKMAEAATDPKEGAADK

SEQ ID NO: 65, myb family transcription factor, putative, expressed, LOC_Os06g45840, coding sequence
ATGTCCATGGATACATCTCCTGTCATCAGAAATACAAATGCCAGTGCTGTAGTACCCTCCTGGGAC
AATTCTATTGCTCAACCTTTAAGTGCAAGTCGCACGCAAGGTACAGGTGCTGTTGCTACAAATAAC
TGCTCTAGTAGCATAGAGAGTCCTTCTACTACTTGGCCAACTTCTGAAGCAGTTGAACAAGAAAAT
ATGCTTCGACCACTACGTGCTATGCCAGATTTTGCACAAGTATACAGCTTTCTGGGAAGCATATTT
GATCCAGATACTAGTGGGCATTTGCAGACTTTAAAGGCGATGGATCCAATTGATGTTGAAACGGTA
CTACTGCTGATGAGAAATCTGTCCATGAACTTAACTAGCCCCAACTTTGCGGCACATCTGAGCTTG
CTGTCATCATGTAATTCTGGTGGGGACCCAATTAAGTCTGAAGGCATGGAAAATCTTGGATCTCCA
CAGAGTTGCCATCTCCCGTTCATGGTAACAAGTGAGTGA

FIGURE 4 (continued)

SEQ ID NO: 66, myb family transcription factor, putative, expressed, LOC_Os06g45840
MSMDTSPVIRNTNASAVVPSWDNSIAQPLSASRTQGTGAVATNNCSSSIESPSTTWPTSEAVEQEN
MLRPLRAMPDFAQVYSFLGSIFDPDTSGHLQTLKAMDPIDVETVLLLMRNLSMNLTSPNFAAHLSL
LSSCNSGGDPIKSEGMENLGSPQSCHLPFMVTSE SEQ ID NO: 67, myb-like DNA-binding domain, SHAQKYF class family protein, LOC_Os08g04840, coding sequence
ATGACGCGTGACGGCGCGCTGCCGGCGAGCGGCGGCGGCGGGGCGGCGGAGGGGCCGAGGCGGTGC
TCGCAGTGCGGGCACCACGGGCACAACGCGCGGACGTGCACGGCGAGGGGCCCCGTGAAGCTGTTC
GGCGTGCGGATCGGCGACAAGCCGCCGACCGCGGCCGCGGGCGGAGGAGGAGGGATGAGGAAGAGC
GCCAGTATGGGGAGCCTCGCGCAGCTGGCGGAGGGGGCGGCGGCGGCGGCGGGAGGGAGGAGGGG
TACGGCTCCGATGGGAACGACGACAAACGGCGGAAGCGAGGTGAGGCATGGTCAGAAGAGGAGCAC
AAAAAGTTTCTACTTGGGCTTAGTAAGTTAGGAAAAGGTGATTGGCGCGGCATATCACGCAATTAT
GTTGGTTCAAGGACGCCTACTCAAGTTGCTAGCCATGCTCAAAAGTACTTCATTCGCCAAACAAAT
GTGCACAGGAGAAAAAGAAGATCAAGCCTTTTCGATATGGTTATAGATGATTCTGATGACCAACCA
CTGTCCCGTACATCTTCACAAGAAGTAGAAGTAGAAGAGAATCTAGAAGATGGACATCCTGTTACT
GCACCAGTGATCCCACCTGCTCCTGTGCCTATGCTATCATCCTCTTTGGTTCCGCCACCAGTACCA
GCAATGGCACCAGTTGCTCCAGGTCCTGTGTTAACATCTGCTTCGGCCACACTACCAGTGTCAGCA
GTGGCACCCCAAACCGATGAAAAGGAACAAGTTGCCTCAGGTTCAAATACAACAGAGACAGGGCT
GCAATTCCAGAAGTCATGCCCCCATATGGTTATCCAATGATGCTTCCTCCATACTACCCACCGGCA
TTTGTTCCAATGCCCTACTATGGTTATGTGCCTGTTTTCTATGCACCACCAGGAGCAGTGCAAGCA
CAACATGAGGTTGTCAAGCCTGTGGCCGTGCACTCAAAACCTCCAGTGCACATCGATGAACTCTAC
AGCATGTCCGAACTCAGCCTGAAGGGCGAGGCTGGTGTGAAAAACGGCACTCCTAATTCTCTGTTG
CCTCCAAGACCAATTGGTAGACCAGACAGGCAATCTGCTTTTCATGGAAAAGGACCTTCTGATGGC
TCTTCAAATGGACTGATTCCTGCAAAGTGA SEQ ID NO: 68, myb-like DNA-binding domain, SHAQKYF class family protein, LOC_Os08g04840
MTRDGALPASGGGGAAEGPRRCSQCGHHGHNARTCTARGPVKLFGVRIGDKPPTAAAGGGGMRKS
ASMGSLAQLAEGGGGGGGREEGYGSDGNDDKRRKRGEAWSEEEHKKFLLGLSKLGKGDWRGISRNY
VGSRTPTQVASHAQKYFIRQTNVHRRKRRSSLFDMVIDDSDDQPLSRTSSQEVEVEENLEDGHPVT
APVIPPAPVPMLSSSLVPPPVPAMAPVAPGPVLTSASATLPVSAVAPQTDEKEQVASGSNTTETGA
AIPEVMPPYGYPMMLPPYYPPAFVPMPYYGYVPVFYAPPGAVQAQHEVVKPVAVHSKPPVHIDELY
SMSELSLKGEAGVKNGTPNSLLPPRPIGRPDRQSAFHGKGPSDGSSNGLIPAK SEQ ID NO: 69, myb-like DNA-binding domain, SHAQKYF class family protein, LOC_Os08g05510, coding sequence
ATGCCTCAAGATTCGCGCCCCGCCGCGATGCGCCTCTTCGGCGTCACCATCTCGCCGCCGCCGCCG
CCGCCGGAGCCGGAGCCGGAGCCGGATCCGTCCGACCCCCGGGATCCGAGCCCGCGGCCGGCGAGG
GAGGACGCGATGCGCAAGTGCAAGAGCATGGGCAACCTCGCCGCCGCCGCCGCCGCCTCCTCCGCC
GCAGCCGGCGGCGGCGGCGCCGGGGACGCCGGGGGATCGGGCGACGGGTACCTCTCCGACGGTGGG
CTGCTGCTGTCCTCCGGCAAGCGGCGGCGCGCGCAGGAGAGGAAGAAAGCTGTCCCTTGGACTGAA
GAAGAGCACCGAACATTTCTTGCTGGTCTTGAAAAGCTAGGAAAGGGGGACTGGAGGGGTATATCT
AAGAACTTTGTTACTACCAGGACTCCAACTCAAGTGGCTAGTCATGCTCAGAAATATTTTCTTAGA
CAAACTAATCCAAACAAGAAGAAGCGCAGATCAAGCCTTTTTGATATGATGGCAACTGATATGTCA
CCAGCACCAAACTGCCCTGTCTTGCCACCATCAATGGGAAAATTACATGATATGGTAGCTATGACT FIGURE 4 (continued)

```
AAACAACTCCAGAACAGCAGTTTGGAAGGAGTCTCATCTTCAAGCACAGTTAATCTAGCACCACAA
GTTGCAAGAGATCTTCCTCCCCCAATTCCATCTTTTAAAGCAACAAATGTAGATTCAAGTCTCAGC
AAAATGAACCACATGGACGGTTTCTTGAGGGCGCCCATGCTGTTCAGACCAATTCCAAGAATCGCT
GAAGGGGCATCTTCATCGACTCCTGCAACTGCAAGCATAGCTGATCTGGAATTTCAAGCTAACCTG
ACTGCATGTTCTAATGCATTATTCGCGAGTCCGAGAAGAAAGCCAAAGAAGGCAGATCCTCCAGCA
GAGAAGGATCTGGATCTGACAGTTGCCCCACCCTCCCAACAAACCAGGGCCAGTATTTCTTCCCAG
AACGCAGTAGGCGTAATTCAAGTCGTATAG
```

SEQ ID NO: 70, myb-like DNA-binding domain, SHAQKYF class family protein, LOC_Os08g05510
```
MPQDSRPAAMRLFGVTISPPPPPPEPEPEPDPSDPRDPSPRPAREDAMRKCKSMGNLAAAAAASSA
AAGGGGAGDAGGSGDGYLSDGGLLLSSGKRRRAQERKKAVPWTEEEHRTFLAGLEKLGKGDWRGIS
KNFVTTRTPTQVASHAQKYFLRQTNPNKKKRRSSLFDMMATDMSPAPNCPVLPPSMGKLHDMVAMT
KQLQNSSLEGVSSSSTVNLAPQVARDLPPPIPSFKATNVDSSLSKMNHMDGFLRAPMLFRPIPRIA
EGASSSTPATASIADLEFQANLTACSNALFASPRRKPKKADPPAEKDLDLTVAPPSQQTRASISSQ
NAVGVIQVV
```

SEQ ID NO: 71, myb-like DNA-binding domain, SHAQKYF class family protein, LOC_Os08g06110, coding sequence
```
ATGGAGATTAATTCCTCTGGTGAGGAAGCGGTGGTAAAGGTGAGGAAGCCATACACAATCACAAAG
CAGAGGGAGCGTTGGACTGAGGCAGAGCACAACAGGTTCCTTGAAGCCTTGAAACTGTATGGAGA
GCCTGGCAGCGCATAGAAGAGCATGTTGGGACAAAGACAGCTGTGCAGATCAGAAGTCATGCTCAA
AAGTTCTTCACCAAGTTGGAAAAGGAAGCTATCAACAATGGCACTTCTCCAGGACAAGCTCATGAC
ATCGACATACCTCCACCACGACCAAAAAGAAAACCTAACAGTCCATATCCTCGAAAAAGTTGTCTC
AGCTCTGAGACATCCACCAGGGAAGTTCAAAATGATAAGGCAACAATATCAAATATGACGAACAAT
AGCACTGCACAAATGGCAGGTGATGCAGCTCTTGAGAAACTTCAAAGAAAGGAGATATCTGAAAAA
GGAAGTTGCTCCGAAGTTCTTAATCTCTTTCGAGAAGTCCCATCGGCATCATTTTCTTCAGTTAAC
AAAAGCTCTTCAAATCATGGTGCATCCAGGGGCTGGAACCGACTAAAACAGAAGTCAAAGATGTG
GTCATCTTGGAAAGGGATTCTATTTCCAATGGTGCAGGGAAGGATGCAAAAGATATCAATGATCAA
GAAATGGAAAGGCTCAATGGGATACACATCAGCTCGAAGCCTGATCATTCTCATGAAAACTGTTTG
GATACCTCAAGCCAACAATTTAAGCCAAAATCAAACTCTGTGGAGACAACATATGTGGATTGGTCT
GCTGCAAAAGCTTCACACTACCAAATGGACAGAAATGGGGTTACTGGCTTTCAAGCCACTGGAACT
GAAGGAAGCCATCCTGATCAAACAAGTGATCAAATGGGAGGAGCCAGCGGAACTATGAATCAATGC
ATCCATCCAACACTTCCTGTGGATCCAAAATTCGACGGCAATGCCGCAGCACAGCCCTTTCCTCAC
AACTATGCAGCCTTTGCACCAATGATGCAATGCCACTGCAACCAAGATGCCTACAGATCTTTTGCC
AATATGTCATCCACCTTCTCCAGCATGCTTGTCTCCACATTGTTGTCAAACCCTGCAATCCATGCA
GCTGCCAGGCTTGCAGCATCGTACTGGCCTACAGTAGACGGCAATACTCCTGATCCAAATCAAGAA
AATCTTTCTGAGAGTGCTCAAGGAAGCCACGCTGGCTCTCCTCCCAACATGGCATCTATTGTCACA
GCTACAGTTGCTGCAGCATCAGCATGGTGGGCAACACAAGGTCTTCTCCCTCTTTTTCCTCCACCT
ATAGCTTTTCCATTTGTTCCAGCTCCTAGTGCTCCCTTTTCCACAGCAGATGTTCAGCGAGCTCAA
GAGAAAGATATAGACTGCCCAATGGATAATGCACAGAAGGAATTGCAAGAAACTCGGAAACAAGAT
AATTTTGAAGCTATGAAGGTCATAGTGTCTTCAGAGACTGATGAGAGTGGAAAAGGAGAAGTGTCG
CTCCACACTGAGTTAAAGATATCTCCAGCAGATAAGGCCGACACCAAACCTGCCGCAGGAGCTGAA
ACAAGTGACGTTTTTGGAAATAAGAAAAAGCAGGATCGCTCTTCATGTGGTTCCAACACACCGTCA
AGTAGTGATATAGAAGCAGATAATGCTCCTGAGAATCAAGAAAAGGCTAACGACAAGGCAAAGCAA
GCATCTTGCAGTAACTCTTCAGCCGGTGACAATAACCACCGTAGATTTAGGAGCAGTGCAAGCACA
AGTGATTCATGGAAGGAAGTTTCTGAAGAGGGTCGTCTGGCTTTTGATGCACTGTTCAGTAGAGAA
```

FIGURE 4 (continued)

```
AGGCTTCCCCAAAGCTTTTCTCCTCCGCAAGTAGAAGGATCAAAGGAGATTAGCAAGGAGGAAGAA
GATGAAGTAACCACGGTGACGGTTGACCTCAACAAGAATGCCGCTATTATTGATCAAGAACTCGAC
ACAGCGGATGAGCCAAGAGCTTCCTTTCCTAATGAATTGTCAAACCTGAAGCTGAAATCTCGCAGG
ACCGGTTTCAAACCATACAAGAGGTGCTCAGTGGAAGCGAAGGAGAACAGGGTACCGGCTAGCGAT
GAGGTTGGTACCAAGAGGATTCGTCTTGAGAGCGAAGCATCGACATGA
```

SEQ ID NO: 72, myb-like DNA-binding domain, SHAQKYF class family protein, LOC_Os08g06110
```
MEINSSGEEAVVKVRKPYTITKQRERWTEAEHNRFLEALKLYGRAWQRIEEHVGTKTAVQIRSHAQ
KFFTKLEKEAINNGTSPGQAHDIDIPPPRPKRKPNSPYPRKSCLSSETSTREVQNDKATISNMTNN
STAQMAGDAALEKLQRKEISEKGSCSEVLNLFREVPSASFSSVNKSSSNHGASRGLEPTKTEVKDV
VILERDSISNGAGKDAKDINDQEMERLNGIHISSKPDHSHENCLDTSSQQFKPKSNSVETTYVDWS
AAKASHYQMDRNGVTGFQATGTEGSHPDQTSDQMGGASGTMNQCIHPTLPVDPKFDGNAAAQPFPH
NYAAFAPMMQCHCNQDAYRSFANMSSTFSSMLVSTLLSNPAIHAAARLAASYWPTVDGNTPDPNQE
NLSESAQGSHAGSPPNMASIVTATVAAASAWWATQGLLPLFPPPIAFPFVPAPSAPFSTADVQRAQ
EKDIDCPMDNAQKELQETRKQDNFEAMKVIVSSETDESGKGEVSLHTELKISPADKADTKPAAGAE
TSDVFGNKKKQDRSSCGSNTPSSSDIEADNAPENQEKANDKAKQASCSNSSAGDNNHRRFRSSAST
SDSWKEVSEEGRLAFDALFSRERLPQSFSPPQVEGSKEISKEEEDEVTTVTVDLNKNAAIIDQELD
TADEPRASFPNELSNLKLKSRRTGFKPYKRCSVEAKENRVPASDEVGTKRIRLESEAST
```

SEQ ID NO: 73, hypothetical protein, LOC_Os10g41200, coding sequence
```
ATGACGAGGCGGTGCTCGCACTGCAGCCACAACGGGCACAACTCGCGGACGTGCCCCAACCGCGGG
GTCAAGATCTTCGGGGTGCGCCTCACCGATGGCTCCATCCGCAAGAGCGCCAGCATGGGGAACCTC
TCCCTCCTCTCCTCCGCCGCCGGATCCACCAGCGGCGGCGCCTCCCCCGCCGACGGCCCCGACGCC
GCCCCCACCGCCGCCGACGGCTACGCCTCCGACGACTTCGTCCAGGGCTCCTCCTCCGCCACCCGC
GACCGCAAGAAGGGTGTTCCTTGGACTGAAGAAGAACACCGGAGGTTTTTGCTTGGATTGCAAAAG
CTTGGCAAAGGTGATTGGCGAGGAATCTCTCGTAATTTCGTGGTCTCAAGAACACCTACTCAAGTA
GCCAGTCATGCTCAGAAATATTTTATACGCCAATCCAATATGACCAGAAGGAAAAGAAGGTCTAGC
CTTTTTGACATGGTGCCAGATGAGTCTATGGACCTTCCACCACTTCCTGGAGGTCAAGAACCAGAG
ACCCAAGTATTAAATCAACCAGCACTACCTCCACCGAGGGAGGAGGAGGAGGTAGATTCTATGGAG
TCAGATACTTCTGCCGTTGCAGAGAGCTCTTCCGCTTCTGCTATCATGCCAGATAATTTGCAGTCG
ACCTATCCAGTGATTGTTCCAGCTTATTTCTCGCCCTTTTTGCAATTCTCGGTTCCTTTCTGGCAA
AATCAGAAAGATGAAGATGGTCCTGTGCAAGAAACACATGAGATTGTCAAGCCTGTTCCAGTTCAT
TCAAAGAGCCCAATCAACGTTGATGAGCTTGTTGGCATGTCGAAGCTCAGCATAGGAGAGTCCAAT
CAAGAGACAGTGTCTACTTCTCTTTCATTAAATCTGGTAGGAGGTCAAAATAGACAATCAGCTTTC
CATGCAAATCCACCAACAAGGGCACAGGCATGA
```

SEQ ID NO: 74, hypothetical protein, LOC_Os10g41200
```
MTRRCSHCSHNGHNSRTCPNRGVKIFGVRLTDGSIRKSASMGNLSLLSSAAGSTSGGASPADGPDA
APTAADGYASDDFVQGSSSATRDRKKGVPWTEEEHRRFLLGLQKLGKGDWRGISRNFVVSRTPTQV
ASHAQKYFIRQSNMTRRKRRSSLFDMVPDESMDLPPLPGGQEPETQVLNQPALPPPREEEEVDSME
SDTSAVAESSSASAIMPDNLQSTYPVIVPAYFSPFLQFSVPFWQNQKDEDGPVQETHEIVKPVPVH
SKSPINVDELVGMSKLSIGESNQETVSTSLSLNLVGGQNRQSAFHANPPTRAQA
```

FIGURE 4 (continued)

SEQ ID NO: 75, hypothetical protein, LOC_Os10g41260, coding sequence
ATGGAGCAGCATGAGGAGGCAGCGGAGAGGAAGCCTTCGCCGCCGGTGATATTCCGGCTGTTCGGC
GTCGAGGTCCGCGGCGGCGGCGGCGGAGTTGACGAGGAGGAGTACGAGGAGGAGGAGGTGGAGGGT
GGATTGTTCATCAAGAAGAGCTCCAGTATGCCCAACCTCACCTCCATCGACCCGCTGCCGGTGCCG
GCCGACGGCGGCAAACGGCGCGCCTCCGACGACTCCGAGCTCGCCTCCGGCCAGCAGAAGCGCCGC
CGCCGCAAGGTGCAGGAGAGGAAGAAAGGGGTACCATGGACTGAGGAGGAGCACAAGAAATTCCTG
GAAGGGCTGAGGCAGCTGGGGAAAGGGGACTGGAGAGGCATCTCCAAGAACTTTGTGACCAGCAGG
ACGGCGACTCAGGTGGCCAGCCACGCCCAGAAGTACTTCCTCCGGCAGACCAACCCTGGCAAAAAG
AAGCGCCGGGCCAGCCTCTTTGATGTTGTTGCTGAGTGCAGTGATGATCAGCTTCCAAGTCCTCAG
AGTGTTGGAACTAAGCCTCCTACCCAGGATATAATTCATACAGATCGCGGCGATGTCCCGATACTA
AGCTATCCAGTTGCTAGAGGCTTTAGAGGCGATAGCGTGCAGGTTGATGAACTAACTGAATATGTG
AAGAGATTAAAGGCCGCCGAGGACATGTCGCTCTCCATGATCTCTGGACTGGAAATGGCATCATCA
TCCATCAGCAGTCTAGAGCTCAGTATCGCGCCTCCTCATTGCGCGATCGAGGCGGCCATCAAGGTG
CTGTGA

SEQ ID NO: 76, hypothetical protein, LOC_Os10g41260
MEQHEEAAERKPSPPVIFRLFGVEVRGGGGGVDEEEYEEEEVEGGLFIKKSSSMPNLTSIDPLPVP
ADGGKRRASDDSELASGQQKRRRRKVQERKKGVPWTEEEHKKFLEGLRQLGKGDWRGISKNFVTSR
TATQVASHAQKYFLRQTNPGKKKRRASLFDVVAECSDDQLPSPQSVGTKPPTQDIIHTDRGDVPIL
SYPVARGFRGDSVQVDELTEYVKRLKAAEDMSLSMISGLEMASSSISSLELSIAPPHCAIEAAIKV
L

SEQ ID NO: 77, myb-like DNA-binding domain, SHAQKYF class family protein, LOC_Os02g46030, coding sequence
ATGGAGATGGCCTGTTTGCCGGGAAACGCCATGGCAACCGACGAAAACGGTGCCGACGATCGCGCC
GGCGGCGAGAGCACCGTGGATCATCTCAGGAGCCATATGAACTACGGCGACATGGATTTGTCAGGG
GAAGAGCACGTGCCAAAGGCGCGAAAGCCGTACACGATCACGAAGCAGCGCGAGAAGTGGACGGAC
GAGGAGCACAGGCTGTTCTTGGAAGCCCTGCAGCTGCACGGCCGCGCATGGCGCCGTATACAAGAG
CACATAGGTACCAAGACTGCCGTGCAAATCCGTAGCCACGCGCAGAAGTTCTTCTCTAAGGTCGTC
AGAGAATCTTCGGGGAGTAACACCGGCTCGGGCGGCGCGTCCGCCGCGGCGGCGGCGGCCATC
CAGATCCCTCCGCCGCGGCCGAAGAGGAAGCCGGCGCACCCGTACCCGCGCAAGGTGGACGGCGCG
GCCAAGAAGCACGTCCCGGCGCTCAGGCAGCTGGAGAAGCCGCCGTTGTGGATGCAGTCCCTGTCC
GAGCAGGAGGAGGGCTCGCCGACGTCGGTGCTGACGGCGGCGCAGATAGGCACCGAGGCCCTGGGC
GGTGGGTTCTCGAATAACTCGAGCGGCAGCGGGTCGCTGGCTCCGTCAGCCGCCGGTACGGATGAG
CATGTCGACGGTGGCGGCTCGCCGGCGTCGTCGGTGGACAGAGAGGACGGGTGCCTCTCACCGAGC
ATCCCGACTGCTGAGTTGGCTATGCAGGCGCCAAATACTAAGATGTCAATTGCAACCACGGATGCC
AAAGAAGCATCCTCAGAAGCATCAGTCTTCAGGCTATTCGGAAAGAGCGTAGTGGTTAAGGATTCA
GACCAGCTGCACCTGCTTAATGGCAGTAACATTGCAACGAGTGGTTCAGTTGAGAGAGCAACCAGA
AACATACTAGTACCTTCTTTTGCTGCTGCCCCAGAAGGGAGCTCGTCGAATCCATGGCCGAGCAGC
ATGCAACAGTTTCTCTACTTCCTTCCTCGATCGGATGGTTTCGCCGCGCAACCTGTCATGCCATGG
TTGAGCTACAACGGGAGCCTTCCATGCGCGCTGTTCTACCCGGCGGCGGCGGCGGCTGCGAACCAG
CAGTGCCACCGTGATTCAGAGGGCGTAGAGTTCAGAGTCTCGCAGAGGGAAGGATCGCTGACGGGC
TCGAACACGGCCTCCAGCGTCGTGCTTGGATCGTCGGCGGCGGTACCGGCGGCGGCGGCGGCGGCT
CAGAATTCGGACGTCGCGGAGTCCCGTGGCCAAGGGAACAGCAGGGAGGCGGCGGCCTCGCCACGG
CTGACCAAGTGCGAGAGCTCGGCGTCCGTCACCCTGCTGCAGAGGGGCTTCATGCCGTACAAGAGG
TGCGCGGCGGAGAGCGAGCTGCTGCGATCGGAGGCCGCCGGAGGAGAGGAGGCCGTCGCCGACGGT
GAGCTGACAAGGCTGTGCTTGTGA FIGURE 4 (continued)

SEQ ID NO: 78, myb-like DNA-binding domain, SHAQKYF class family protein, LOC_Os02g46030
MEMACLPGNAMATDENGADDRAGGESTVDHLRSHMNYGDMDLSGEEHVPKARKPYTITKQREKWTD
EEHRLFLEALQLHGRAWRRIQEHIGTKTAVQIRSHAQKFFSKVVRESSGSNTGSGGASAAAAAAAI
QIPPPRPKRKPAHPYPRKVDGAAKKHVPALRQLEKPPLWMQSLSEQEEGSPTSVLTAAQIGTEALG
GGFSNNSSGSGSLAPSAAGTDEHVDGGGSPASSVDREDGCLSPSIPTAELAMQAPNTKMSIATTDA
KEASSEASVFRLFGKSVVVKDSDQLHLLNGSNIATSGSVERATRNILVPSFAAAPEGSSSNPWPSS
MQQFLYFLPRSDGFAAQPVMPWLSYNGSLPCALFYPAAAAAANQQCHRDSEGVEFRVSQREGSLTG
SNTASSVVLGSSAAVPAAAAAAQNSDVAESRGQGNSREAAASPRLTKCESSASVTLLQRGFMPYKR
CAAESELLRSEAAGGEEAVADGELTRLCL

SEQ ID NO: 79, myb-like DNA-binding domain, SHAQKYF class family protein, LOC_Os04g49450, coding sequence
ATGGCGCGTTTTCAGGAAACCAAGGCGAGGAATGATCAAGGACCTGTTGCTGATCATGTTGGGCAC
CAAAACCCTCATGGAAAACCTCACAGATCCTCTGGATTCCAGTGGCATGGACATGATGGACGAAGCG
CGAATTCCTAAGGCGCGGAAGCCATACACGATAACGAAGCAAAGGGAGAAATGGACCGAGGACGAA
CATAAGCTGTTCTTGGAAGCCCTGCAGCTCCATGGCCGAGCCTGGCGACGCATCCAAGAGCACATA
GGCACCAAGACTGCCGTGCAGATCAGGAGCCACGCACAGAAGTTCTTCTCCAAGGTCATCAAAGAA
TCATCTGGGGACAATTGCAACAGCTTGGGTGCTGCATCATCAATTCAGATTCCCCCGCCGCGGCCG
AAGCGTAAGCCTGTTCATCCGTACCCACGCAATCTAGGGAGCACAGCCAGCAAGAACGTCCCTGCA
CTGAAACAGCTAGAGAAGCCTCAGCTGCAGGTGCAGTCTCTCTACGACCAGGACAATGGGTCGCCG
ACGTCAGTGTTAACAGTACCACAGATACGGGCTGATACACTGGGAAGTGAGAGTGGTGGGTCGCCA
ACCTCGACGATTGATATTGAAGAGAGATGTCCTACACCAAGCATAGCAACTGCTGAGTTAGCTATG
GAGTTGCCTCCTACAAATGACGAGGAGGTCAAGGGCAATGGCGATCATGAAGAAGTTACATGTGAC
AGATCAGGAGTTCCAGTCCTTAGGCTATTTGGCAAGAGGGTTATGGTGAATGATTTACATCAGATG
TCAGCCCCTGATGCCGGGAACCTGCAAACTGTGGCAGACATGGAAGTGGACGCTTCAGCTGAGACA
CCAACTAGTGGAACTGGGAAATTCTCTTCCCATGGTGCAGCAGAAGCAAATACATGGAACCCATGG
CTGACTAACACACAGCAGTTTCTGTATTATCTTCCTAACGGACAAATTTTCTCCGTGCATTCTGCT
CTCCCATGCTTCACCTACCATAATGAGGGTGTTACTTGCACCCAGTTTTCAAACCCACAGGTGGTA
GCCTCAGATCAACAGCATCAACACCAAACTTCTGAAGCTGTAGATTACAAGGGTATACAGAGGGAA
GGATCTTGGACGGAGTCAAATACATCCTCAAGCAGTGTGCCTGAAACAGCAACTCATAATTCAGAG
ACTACAGAATCATATAGAAACGGAAACAGAAACGAAGATGAAATGGTACCTTCTCCAGATTCAAGA
AAATGTGTGAGCCCAGGTTCCAACTGCAGGCGAGGCTTTGTGCCGTACAAGAGATGTGTTGCTGAT
AGTGAGGCGCTGCTGAAGTCACAGGCGCCTCAGGAGGAGGCAGACGGAGAGATGACGAGGCTGTGC
TTATAA

SEQ ID NO: 80, myb-like DNA-binding domain, SHAQKYF class family protein, LOC_Os04g49450

MARFQETKARNDQGPVADHVGHQNLMENLTDPLDSSGMDMMDEARIPKARKPYTITKQREKWTEDE
HKLFLEALQLHGRAWRRIQEHIGTKTAVQIRSHAQKFFSKVIKESSGDNCNSLGAASSIQIPPPRP
KRKPVHPYPRNLGSTASKNVPALKQLEKPQLQVQSLYDQDNGSPTSVLTVPQIRADTLGSESGGSP
TSTIDIEERCPTPSIATAELAMELPPTNDEEVKGNGDHEEVTCDRSGVPVLRLFGKRVMVNDLHQM
SAPDAGNLQTVADMEVDASAETPTSGTGKFSSHGAAEANTWNPWLTNTQQFLYYLPNGQIFSVHSA
LPCFTYHNEGVTCTQFSNPQVVASDQQHQHQTSEAVDYKGIQREGSWTESNTSSSSVPETATHNSE
TTESYRNGNRNEDEMVPSPDSRKCVSPGSNCRRGFVPYKRCVADSEALLKSQAPQEEADGEMTRLC
L

FIGURE 4 (continued)

SEQ ID NO: 81, myb-like DNA-binding domain, SHAQKYF class family
protein, LOC_Os06g51260, coding sequence
ATGGCTTCCATGCCGCAGCTGGAGGAAAAGGATTCATCCGATTTGGCAATCAACAAAGGCCCGTCG
CTGGATCTTGTCAAATCTCCCTTGATGATGAATGATGCATCTGCAACTGTAACTGCAATGCAGCCC
AACGAGGGGATGGAGGAGTTCCCTGTCAAGGTTCGGAAGCCTTACACGATCACCAAGCAGCGGGAG
AAGTGGACGGAAGAAGAGCACGACAAGTTCCTTGAGGCATTGAAGCTGTATGGTCGCTCTTGGCGT
CAGATACAAGAGCACATTGGCACAAAGACTGCTGTCCAAATTCGGAGCCATGCCCAGAAGTTTTTC
TCAAAGGTGGTGCGTGAGCCCGGTTCCAATAATGCGATTGAGATCCCTCCACCTAGGCCAAAGAGA
AAACCACTTCATCCGTACCCTCGAAAGTGTGCGAATTCTGGATCGGACGCAAATCCAGCAACAGCG
CAATTGAAGCTTGCTCCTGGCTCATCTTCATCTGGCTCTGATCAAGAGAATGGTTCTCCTATATCG
GTGCTATCTGCGATGCAGTCAGATGCTTTTGGATCGTCAGTATCCAATCCATCAACCAGATGTACC
TCCCCAGCGTCATCTGACGATGGAAATAACATTCCCACATTCACGAGTGGGGAAGATAATAATGTG
CCTTGTGAACCAACAGTGATAGATCCGTCCCAGTCCCACAAGGAAATAGACCAAGATAGAAAAGAC
GTGAATAATATGTCTGAAGAGGATTCTTCAGAAGAAGAGGTGCAAGAAACAAGCTTGAAGCTATTT
GGGAGGACAGTTGTCATCCCAGATCCAAGGAAGAGAAGCTCCTCAGATCCGAAGCATGAAAGTGAG
GAGCAGATATCACAGCCTTCCAATGAAGAAATGTTGCAGGCTTCTTCATCGGTTGGGGAGATTCCA
GCGGCATATTGTGCACCAAATGGTTGGTTTATGTCATACAATTCTTTCCCATTCCAATTCGGTGAA
TCAGCGGCAGATGCTAGAATTCCCCCTTTACACGTGTGGTGGCCTTACTACGGTTTTGCTCCCATT
AGCCATCCTAGAGGACTAAGCACAGTGATGCAGCAGACTGAAGGTAGTGACGAGAGTGACGGTGTG
AAGAGCCACTCATCCGAATCAAGTTCGGACTCCGGGGAAAATGTGCAGATGACCGCTCCCCAGAGC
TCGAGAATAGTGGAATCACTTGGAGCGATTTACGTCCGAGACTCAGGTTCAAGTTTTGAGCTAAAA
CCGAGCGCAAATTCAGCGTTTGTAAGAGTGAAGCCAAGCAACAGCGGAGATGAAGAGGTAATAAGG
GGATTTGTGCCTTATAAAGATGCAAATTTCAATAA SEQ ID NO: 82, myb-like DNA-binding domain, SHAQKYF class family
protein, LOC_Os06g51260
MASMPQLEEKDSSDLAINKGPSLDLVKSPLMMNDASATVTAMQPNEGMEEFPVKVRKPYTITKQRE
KWTEEEHDKFLEALKLYGRSWRQIQEHIGTKTAVQIRSHAQKFFSKVVREPGSNNAIEIPPPRPKR
KPLHPYPRKCANSGSDANPATAQLKLAPGSSSSGSDQENGSPISVLSAMQSDAFGSSVSNPSTRCT
SPASSDDGNNIPTFTSGEDNNVPCEPTVIDPSQSHKEIDQDRKDVNNMSEEDSSEEEVQETSLKLF
GRTVVIPDPRKRSSSDPKHESEEQISQPSNEEMLQASSSVGEIPAAYCAPNGWFMSYNSFPFQFGE
SAADARIPPLHVWWPYYGFAPISHPRGLSTVMQQTEGSDESDGVKSHSSESSSDSGENVQMTAPQS
SRIVESLGAIYVRDSGSSFELKPSANSAFVRVKPSNSGDEEVIRGFVPYKRCKFQ SEQ ID NO: 83, AB210845.1, Lemna paucicostata LpLHY H1 mRNA for
LHY homologue1, complete cds
CTAATACGACTCACTATAGGGCAAGCAGTGGTATCAACGCAGAGTACGCGGGCGGAAAAGATCGTG
GCTGAGATTTATCCACTTCGAAGAACTAGAGAGAGAAAGAGGGAGCTCAAGCGAGCTTAAGTCTGC
GGCGGAGGAGAGATTCCTTTCTTTTCTCCGCTTTTCCTTCCTCTTAGAGCTGGAGATCTGTTGCC
ACGGCTTAAATCTCGATCCGAGCGGTTTTAGCCGCGGAAATTGCGGTTTGATTGGGCAGGGAGATG
AGAAAGAAGAGAAGAAGAGCGGAGAAGAGATGATTATCGGTTTTGGCGCCGGATTTAGATATATG
TTATATCGAGTACAGTTGTATTAATTCCTGTTAAGTGATCCAATTAAGTAGAATTACTGGATTCTT
TAATCGCTATGGTTTCCTTTAGTTTCTTGGTTCATCCCAGATTATTTGATGCTAAGCCAATTTGCA
GTTATTATTTGAATTCTGTGAGAAATTTTCACGGCGAATCGAAATGGAGAGAAGATGCAGGCTCGA
AGAGGATTGCTCGAAGTGAACTGCTCCGTCTTTTTGCTATTTGTTACTGCACATTGCAGTAATGG
AAACATGTTCTTCCGGAGAGGAATTGGTCATAAAGCCAAGGAAACCCTACACCATAACCAAACAGA
GAGAGAAGTGGACCGAGGAGGAACACAACAGATTCCTGGAAGCCTTGAAGCTCTATGGAAGAGCAT FIGURE 4 (continued)

```
GGCAGCGAATCGAAGAGCACATTGGAACAAAGACTGCTGTGCAGATTAGAAGTCATGCACAGAAGT
TCTTCACTAAGTTAGAAAAAGAAGCCGTCTCCAAAGGCGTTCCCCTCGGCCAAGTCCACGACATCG
ACATCCCTCCTCCCCGCCCCAAGCGGAAACCCAACAACCCTTACCCTCGTAAGCTCGGTGTGGGTC
CCACCTGCCCTTCTGGCTCGGAGAGAGAAGATAACAAGACGTTGACTCACCTTCCTTCTCTGAACT
CCAAGGGGAAAGCCGAAGATTCCCCCGAGTCGTCCCACGAGAACCAAGCTGGAATAAAGCCAGATA
AGAAAACCCCGGAGAGTCCAGTCATTCTCTCTCTCTTCCACGTGGCGCCACCTCCTTCCACCCCTT
CCTCCAGCAAATCCCCGGTGTCTTCCTTGGGTAAGGGAATGGCAGAAGAAAACAACCCTAAAATCT
GCCACGTTGACCGAGTCAACCCCAAACTCCCATCCCCGTCAGCAATCTCCTCGGTCCACCAATCCC
ATCCCTTCTCCTGGCCCCACATCCCGCCCGCATTCTCCACACATCTGACGTCAGCCCTAGTTCAAA
ACCCTGCAGCTCATGCAGCTGCTAACTTGGCAGCGTCTTATTGGTTGAGTGCTGACGTGGAAGCCG
CCTCCTCAGTAGACTCCGCCAGCTCTGCGTCTCCCACCATGGCCGCCGCAGCTGCCGCCACCGTGG
CTGCCGCCTCCGCCTGGTGGGCCACCCAAGGGTTGCTCCCCTTCTGCTATCCTTCGTTCAACGGCT
GCTTCGCCGCTTTCGCGCCGCCGCCGACTCCCATCACGTTGACTGAGTCAACGGGAGTCAAGGTTA
ACCCTAATGTAGAAGAACAAGAGGAACAGGGCCGTTCAAAGGGGTCGCCTTTATCGTCCACGGACT
CAAACCCTAGCGAGAAGAGAGAAGTCAACGGCGAGGGGGAGGTCAAAGTCCAAGGTCAAAGCTTGA
CCCAACGAGAGGAAAAGTCAACCCTAGAGGGGAAGAATCAGTTGGACCGGTCTTCCTCCGGGTCAA
ACACACCTGGAAGCGAAGTGGAGAATGAAGGTGTGGAGCCCACAGAGGATGAAATGCCCAAAGAGG
AGGCTGTTGACCCTACTCGCCGCGGAGTTGACCCCGAAAAGAAGTCTCCAAAGAGGGCCGCCTCG
CCTTCCAAGCGCTCTTCTCCCGGGAAGTTCTACCGCAGAGCTTCTCCCCCACCGAGACAGAAGACC
AAAAGGAACAAAAGTCAACGGAAGTCAACCCTCACCCGGAAGTCAACCCCGTTGACCGAATCCCCG
CAGAGCTAAGTCAACACAGGCTCAAGCCTCACTGCACAGGATTCAAGCCTTACAAGAGGTGCTCGG
TGGAGGCCAAACAGACGGAGCCGCCGCCAGAAGAAGATAAATGTAGTAAGAGAATATGTCTGGAGA
GAGAGGCCTCCATTTGACTTGGTCAACGCTTCGACCAAGTCTTTCTCTCTCTTACCCTTTACCTGT
CAAACTTTGGAACCNCCTTTTTTTTCTTCTCATATTCTTTCCCCAGGGGACTGCCATGATTCNCG
GTAAAAAAAAAAAAAAAAAAAAAAAAA
```

SEQ ID NO: 84, BAD97866.1, LHY homologue1 [Lemna paucicostata]
METCSSGEELVIKPRKPYTITKQREKWTEEEHNRFLEALKLYGRAWQRIEEHIGTKTAVQIRSHAQ
KFFTKLEKEAVSKGVPLGQVHDIDIPPPRPKRKPNNPYPRKLGVGPTCPSGSEREDNKTLTHLPSL
NSKGKAEDSPESSHENQAGIKPDKKTPESPVILSLFHVAPPPSTPSSSKSPVSSLGKGMAEENNPK
ICHVDRVNPKLPSPSAISSVHQSHPFSWPHIPPAFSTHLTSALVQNPAAHAAANLAASYWLSADVE
AASSVDSASSASPTMAAAAAATVAAASAWWATQGLLPFCYPSFNGCFAAFAPPPTPITLTESTGVK
VNPNVEEQEEQGRSKGSPLSSTDSNPSEKREVNGEGEVKVQGQSLTQREEKSTLEGKNQLDRSSSG
SNTPGSEVENEGVEPTEDEMPKEEAVDPTRRGVDPRKEVSKEGRLAFQALFSREVLPQSFSPTETE
DQKEQKSTEVNPHPEVNPVDRIPAELSQHRLKPHCTGFKPYKRCSVEAKQTEPPPEEDKCSKRICL
EREASI

SEQ ID NO: 85, AB210849.1, Lemna gibba LgLHY H1 mRNA for LHY homologue1, complete cds
```
CTAATACGACTCACTATAGGGCAAGCAGTGGTATCAACGCAGAGTACGCGGGGGAGGAAGAGGAGG
AAGCGAGCCTTCTCCGAGCTCGATTTCAGCGGCTTCCGGAGCCTGGATTACTCTCTTTTCTTCGCT
TTTTCCTCGCTCTGAGCACTGGAGATCAGTTCAACTAGGTCAGCTCTCAATCTGACCAGTTTTCCC
GAAGAAATTGGGAGATTGGGGAAGCCAGGCGATGAGAAGAAGAGGAGAAGAGGGAATTAGAGAAG
CGCCTTGATTTTGCTGTCAGAGTTAGTTCAACGGAGTTGTGAATTTGATTCTCCAGTTATTCGTC
AGTCCGATCGAAGTCATGGATAGAAGATGCGCCCTCGTTGGGGAATATACGAATTGAGCCTCTCCG
TGTTTTTTGCTCTTTTTTTCTGCGAATTGCAGTTATGGAGACATGTTCCTCCGGAGAGGAATTGAT
CGTGAAGCCAAGGAAACCGTACACGATTACGAAACAGCGAGAGAAGTGGACCGAGGAAGAACACAA
```

FIGURE 4 (continued)

```
CAGATTCCTCGAAGCCTTGAAGCTATACGGAAGAGCCTGGCAGCGAATAGAAGAGCATATTGGCAC
AAAGACCGCTGTACAAATAAGAAGTCATGCACAAAAGTTCTTCACTAAGTTAGAAAAAGAAGCAGT
ATCTAAAGGCGTTCCTCTGGGTCAAGTCCATGATATTGAGATCCCTCCTCCGCGCCCTAAACGAAA
ACCGACCAATCCCTATCCTCGAAAGATCGGTGTGGGCCCCTCCTACCCATCTGGAGGAGAGAGAGA
TGATAACAGACAATTAACGCACCTTCCTTCTTCTTTACATTCCAAGGGCAAAGCCGAAGATTT
TTTCGTCGATTCTTCTCCCGAGAAGCAAGCAGGAATGAACTCGGAGAAAATTACCAAAGAGGCCCC
AGTTGCCCTCTCTCTTCCACGTGGCGCCTTCTTCTCCCACCCCTTCCTCGAGCAAATCCACCGT
TCCTTTACCAGATGACGAAAAAAACCCAAGCATCAATTTTGACTTGAACAAGAAGAACCGCCCTTG
CGGAGTCAACGCAGACCCTAATACAGTCAAATTTCCATCCCCATCGGCCATCTCCTCGGTCCACCA
ATCCACTGCTGCCTTTCCTCATCCATTCAGTTGGCCCCACGTCCCGCCGGCTTTCTCCAGCCACCT
GACGTCAGCCCTACTTCAGAATCCGGCGGCGCATGCGGCCGCCAACATGGCCGCGTCTTTCTGGTT
GACTGCTGACGTGGAGACTTCTTCCTCCGTTGACTCCGGGAATGCCGCCAGCTCGTCTTCCCCTAG
TGTGGCGGCGGCGGCGATTGCCACCGTGGCGGCGGCGTCAGCTTGGTGGGCCACCCATGGACTCCT
CCCTTTCTGCTACCCTTCATTAACGGCTGCTTCGCCGCCGTTCCTCCGCCTCCGACGACCACCCC
GACGCTGACCGAGGCGACCCGAGTCAAAGTCAACCCTCGCAACGGCAAAGAGGAAGAGGAAAAGGA
TCTCCGTCAAGGTTTCGACCCGGGCACGTCGTTGACCGCGAAGGGCTCACCTCTCTCGTCAACAGA
TTCCAACCCGAGTGAGAAAAGAGAGGTCAACGGCGAGGGGAGGTCAATGTCCACGGTCAACCACA
GAACCAGCAGAAGTCCACGCCGGATGAGGAATCTTTTAGGAGAAAGGGAAAGAACCAGTTAGACCG
TTCTTCCTCCGGATCCAACACTCCGGGCAGCGAAGTGGACAACGATGGCGCGGGGCCCACAGAGGA
AGAAAAGCCCAAAGACGACGACCTCTCCGTTGACCCTAACCGCCGAGGAGTTGACCCCCGCAAGGA
AGTCTCCAAAGAGGGGCGCCTCGCCTTTCAAGCGCTCTTCTCAAGAGGAGTGCTGCCGCAGAGCTT
CTCCCCCACAGAGGGAGAGGCGGAGAAAGATGAAGTGTTAGCGCCCGCCTCGGCTCCCTCAGAAGT
CAACGCCCTTCAACCTCCCCAAGTCAACTCCGTTGACCAAACCTCTGTAGATATCGGTCAACTGAG
GCCGAAGCCTCACTGCATAGGGTTCAAGCCCTACAAGCGTTGCTCAGTGGAGGCAAAGGAGACCGA
GCCCCCGCCGGAGGACGACAAATGTAGCAAGAGAATGTGTTTGGAGAGAGAGGCGTCGACTTGAGC
CGGTCACGCTGTCTCGGTCTCCANTGGTTTTCGACGAGTCAACGGNGANCTTGGCATATCNTTTT
CCCNGNGGAANTTTNGANTGCCTTTTTCTNCGAATNTCTTTCNNGGGGGAACTGCCGNAATCCGGG
GTNAATTNTNTTNTGGCNGNGNCNTNGGAANNAATTTNCCNTTCTCTNCCAAAAAAAAAAAAAAA
AAA
```

SEQ ID NO: 86, BAD97870.1, LHY homologue1 [Lemna gibba]
```
METCSSGEELIVKPRKPYTITKQREKWTEEEHNRFLEALKLYGRAWQRIEEHIGTKTAVQIRSHAQ
KFFTKLEKEAVSKGVPLGQVHDIEIPPPRPKRKPTNPYPRKIGVGPSYPSGGERDDNRQLTHLPSS
SLHSKGKAEDFFVDSSPEKQAGMNSEKITKEAPVALSLFHVAPSSPTPSSSKSTVPLPDDEKNPSI
NFDLNKKNRPCGVNADPNTVKFPSPSAISSVHQSTAAFPHPFSWPHVPPAFSSHLTSALLQNPAAH
AAANMAASFWLTADVETSSSVDSGNAASSSSPSVAAAAIATVAAASAWWATHGLLPFCYPSFNGCF
AAVPPPPTTTPTLTEATRVKVNPRNGKEEEEKDLRQGFDPGTSLTAKGSPLSSTDSNPSEKREVNG
EGEVNVHGQPQNQQKSTPDEESFRRKGKNQLDRSSSGSNTPGSEVDNDGAGPTEEEKPKDDDLSVD
PNRRGVDPRKEVSKEGRLAFQALFSRGVLPQSFSPTEGEAEKDEVLAPASAPSEVNALQPPQVNSV
DQTSVDIGQLRPKPHCIGFKPYKRCSVEAKETEPPPEDDKCSKRMCLEREAST
```

SEQ ID NO: 87, AY611029.1, Castanea sativa late elongated hypocotyl (LHY) mRNA, complete cds
```
GCGTGTTTTCGCATCAATTTTTGCGCTGTAGTGAGGATTTGAAGCAGCCCTGCTGGCTGCTCCGCG
TCCGGTAATGGACACATACTCCTCTGGGGAAGAACTGGTTATTAAGGCTAGAAAACCATATACAAT
AACTAAGCAACGGGAGAGATGGACGGAGGACGAGCATAATAGGTTTCTAGAAGCCTTGAAGCTCTA
TGGACGAGCATGGCAGCGGATAGAAGAACATATAGGAACAAAGACTGCTGTGCAGATCAGAAGTCA
```

FIGURE 4 (continued)

```
TGCACAGAAATTCTTTTCAAAGTTGGAGAAGGAGGCTCTTGTTAAAGGTGTTCCAATAGGCCAAGC
TCTTGACATAGATATTCCACCTCCACGCCCTAAAAGGAAACCAAGCAATCCTTATCCTCGAAAGAC
AAGCATCGGCGTTCCTACATCACAGGTGGGAACGAAGGATGGAAAACTTTTCACATCAGCTTCTTC
TTCGGATTGCAAACAAGCACTGGACTTGGAGAAAGAACCACTTCCTGAGAAACCTAATGGAGATGA
GAAACCAGAAAATGCAAAAGATAATCAGGATGACAATTGCTCAGAAGTCTTTACCCTTCACCAAGA
AGTTCATTGTTCTTCTGTTTCTTCAGCAAACAGGAGTTCTGTACCGACTCCCGTTGCTCTCAGAAA
TTTAAACACGTTAAGGGAGTTTGTCCCTTCAATGAAAAGGTCAATAACCCAAGATGAAACAAATGA
ATCTTATGTCACTATTGAACTTAAAGGAAATCAGAAGTTGGAGAAAGCTGATGCCAAACAGACAAT
TCAAGATACTGGCACAAGTAATGGCTCAAAGTTGGGGAATCATAATGTTCTACATGAGAAGCCAAT
TCAAGGTGACAAGACACAGGATTTAAATTGTGCTTTGCCAATGGATGAGATGCAAGCCACTCAGAA
CTACCCAAGGCATGTCCCTGTGCAAGTTGTAGATGGAAGCTTAGGAACATGTACTCAAACTCCTTC
CTCAGATATGTCATTCCAGGACTCCATATTTCACCCAATGGGAGAGGTTCACAGACACCATAATCC
CTTTACAAATCCAGCAGCATCTGCTACCACTGAACATCAAAATAATGTTCCCAGATCTGTTAATCA
ATCATTTCCGGCTTTCCATCCTCCCTTTACCCCAATTCGCCATAACCAGGACGACTACCAATCATT
TCTCCACATGTCCTCCACATTTTCAAGCCTTATTGTCTCTACTTTGATGCAAAATCCTGCAGCCCA
TGCTGCAGCAAGTTTTGCAGCTACAGTTTGGCCCTATGCAAATGTGGAGGCTTCTGCAGATTCTCC
TGCAAGCACGCAAGGGGTTTTTCCACCGAGGCAAATGGGCTCTACTCCAAGTATGGCAGCTATTGC
TGCTGCTACTGTAGCTGCTGCAACTGCATGGTGGGCAGCCCATGGACTGGTTCCCTTATGTGCTCC
TCTTCCTACTGCTTTTACCTGCAATCCTGCATCTACAGCTGCAGTTCCACCAACAGATTCTGGCCA
AGCCCCTGCAGCCAAGACAGAGGGAGAAGTGAATACTCTTCAAACTCCTCCCTTGCAACAACTCGA
CCCAGAATATTCAGAAGCTGTTCAAGCTCAGCATTCAGACTCAAAATTGCCAATTCCGTCATCATC
AGACTCTGAGGAGAGTGGAGGTGCAAAGCTAAACTCTGGGCCAAAAGCTACTGATCATGAGAATGC
TGTAACAGCTACTGAGCTCCATGATTCAAACAAAACAAAAGGCAGAAAACAGGTTGACCGTTCCTC
ATGTGGTTCCAACACAGCTTCTAGCAGTGACAGGGAGACAGATGCATTAGAGAAGCAGGAGATGGG
GAAGGAAGAGCCGAAAGAACCTGATGCAAACCATTCAGCTGCTGATACTAGTAATCGTCGTTGTTG
TAGTAGTAGTAGTAGAAGTTTCAGCTACATGAATGATTCCTGGAAGTCAGTCTCTGAAGAGGGCCG
GCTGGCCTTTCAAGCACTGTTCTCTAGAGAGGTACTGCCTCAAAGTTTTTCACCTCCACATGATCT
GAAGAACATGGGGAATCAAAAGGACAATACCACAGACGATAAGCAAAATGCAAATGAGAATGATGG
AAATGCATCACTGTTAGACCCTCAACAGTCAAAAATCTGGGTCTTGTTCTGTCCAACAAGGAATCTT
AAACTTTGAACCCAACAACAATGGGGAGGGCTGCTGACAATAGGGCTTGCATATGGAAAGCTTAA
GGCTCGTCGAACGGGATTTAAGCCATACAAAAGGTGTTCAGTAGAGGCCAAGGAGAATAGGGTGGC
AAATGCTAGTGGCCAAGGTGAAGAGAAGGGTCCAAAGAGGATACGCTTGGAAGGGGAGGCTTCAAT
TTGAGATTTGATATTGCATTCAATCAAAGGAAACCTTTGTTGTGCATATCTTATTTTCCCCGTAAC
TATGTTCTAATCTCTTTCATTTCAAGTCCATCTCACGAAACTTGTCGTGCATGTGTGTGTACTATA
TTATGTCTACATTTGCTCATATACTATGTTGAACCCCAGGCAACTGCACTAGAAGACTTTCC
```

SEQ ID NO: 88, AAU20773.1, late elongated hypocotyl [Castanea sativa]
MDTYSSGEELVIKARKPYTITKQRERWTEDEHNRFLEALKLYGRAWQRIEEHIGTKTAVQIRSHAQ
KFFSKLEKEALVKGVPIGQALDIDIPPPRPKRKPSNPYPRKTSIGVPTSQVGTKDGKLFTSASSSD
CKQALDLEKEPLPEKPNGDEKPENAKDNQDDNCSEVFTLHQEVHCSSVSSANRSSVPTPVALRNLN
TLREFVPSMKRSITQDETNESYVTIELKGNQKLEKADAKQTIQDTGTSNGSKLGNHNVLHEKPIQG
DKTQDLNCALPMDEMQATQNYPRHVPVQVVDGSLGTCTQTPSSDMSFQDSIFHPMGEVHRHHNPFT
NPAASATTEHQNNVPRSVNQSFPAFHPPFTPIRHNQDDYQSFLHMSSTFSSLIVSTLMQNPAAHAA
ASFAATVWPYANVEASADSPASTQGVFPPRQMGSTPSMAAIAAATVAAATAWWAAHGLVPLCAPLP
TAFTCNPASTAAVPPTDSGQAPAAKTEGEVNTLQTPPLQQLDPEYSEAVQAQHSDSKLPIPSSSDS

FIGURE 4 (continued)

EESGGAKLNSGPKATDHENAVTATELHDSNKTKGRKQVDRSSCGSNTASSSDRETDALEKQEMGKE
EPKEPDANHSAADTSNRRCCSSSSRSFSYMNDSWKSVSEEGRLAFQALFSREVLPQSFSPPHDLKN
MGNQKDNTTDDKQNANENDGNASLLDLNSQKSGSCSVQQGILNFEPNNNGEGLLTIGLAYGKLKAR
RTGFKPYKRCSVEAKENRVANASGQGEEKGPKRIRLEGEASI

SEQ ID NO: 89, AJ420902.2, Phaseolus vulgaris mRNA for LHY protein
ATGGACGCATACTCCTCTGGAGAAGAAGTCGTTGTAAAGACGAGAAACCGTATACGATCACAAAG
CAAAGGGAACGATGGACAGAGGAGGAGCATAATAGGTTTCTAGAAGCTTTGAAACTGCACGGGCGA
GCATGGCAGCGCATAGAAGAGCATATAGGAACAAAGACTGCCGTGCAAATCAGGAGTCACGCACAG
AAGTTCTTTACAAAGTTGGAGAAAGAGGCCCTTGTAAAGGGTGTTCCAATTGGACAAGCTCTTGAC
ATAGATATTCCCCCTCCACGGCCCAAAAGAAAACCAAGCAATCCTTATCCTCGGAAGACCACGATT
GGTACCGCAACATTACATAGTGGAGCAAAGGATGGAAATTTGGTTGAATCTTCACATAACAACCAA
GCACTGGACTTGGAAAAAGAACCACTTCCGGAGAAATATGATTTAGACGAGGGGCTAACAACAGTA
AAGGAAAATAAGGATGAGAACTGCTCAAAAGTATTTAAAGTTATCCAGGAGGTACCCTGTTCCTCT
ATATCTTCAGCAAACAGGAGTTCAATATCTATGTCAGTGCCGCTGGGAAATTCATGCGTATTAAAG
GAGATTACAAGTTCAGTGAAAGAGGTAATAACTCGAGATGAAAATACTGAATCATTTCTGACTGTT
GAACTTGGAAACAGGAATTTGGAGATCAATGATGGAAAACAGGCTAATGGCACTAGTAAAAACTCC
ACGTTGGAGAATTCTGATGCTTTACAAACGAAATTGGTTCAAAATGAGAAAACAGATGGTCTCGAT
AGTGCATTAACAATAGATGGGATGCAAGGCAATCAGAATTACCCTAGACATGTAACTGTGCACGTT
GTTGACGGGAAACTTGGAACAAGTACTCAAAATCCATCACAAGATATGCTGTTTCGAGACTCTATG
TTTCAGCCAATAGGAGGGGATAATGGGCAACCAAATCTTTTCACCAATTCAGCTCCAACGAACACA
AGTGAAAGTCAAAATAATACAGCACGATCTTCTGTTCATCAATCATTTCTTCCGTATCCTCCCTTC
ACACAGCACAATCAGGACGATTACCAATCATTTCTTCACATGTCTTCCACGTTTTCTAATCTTGTT
GTCTCTACCTTGCTGCAAAACCCAGCAGCCATGTTGCAGCAAGTTTCGCAGCTACATTTTGGCCT
TATGCAAATCCAGAAACTTCAGCAGATTCTCCTAGGTGCTCCCAAGGAGGTTTCACATCTAGACAA
ATCGGTTCCCCTCCAAGCGTTGCAGCTATTGCAGCAGCTACTGTAGCTGCTGCAACTGCGTGGTGG
GCAGCTCATGGATTGCTTCCTTTGTGTCTTCCTCTTCATGCTGCTTTTGCCTGTCCTCCTGCATCA
GTGACTGCAGTCCCATCAATGAATCCTCCTGTGCAAGATCAGAAGCATCCAGAATACTCGGAAGCA
CCGCAAGCTCAACATTCAGATTCAAAGTCACTAGCTGTCATTTCATCAGATTCTGAGACTGGAAAT
GCCAAGTTAAATACTTCACCAAAGGCTACTGATCATGTGACGAACGAAACAATTTCTGAGCACCTT
GATTCCGACAAAACAAAGGGCAGAAAACAGGTTGACCGTTCCTCGTGTGGTTCCAACACAGCCTCA
AGCAGCGATGTGGAAACTGATGCACTAGGGAAGGATGAGAAAGGGAAGGAAGAGCCTGAAACACCC
GACGCTAACAATTTAGCCATTGAGTTTAGTAATCGTCGTAGAAGCATTTACAACCTTACTGATTCT
TGGAAAGAGGTCTCTTCAGAGGGGAGACTAGCATTTCAGGCTCTATTCTCCAGAGAGGTGTTGCCT
CAAAGCTTTTCACCTCCTCATGCTCTAAAGAATAAGGACCAAATGGACATCACCAATGATTACAAG
CAAAACATAGCCGACAGAAATGAAGACCTTGACAGCAAGAAATGCAGTTCTAATGCACTGCATAAA
ATTCCGTCGTTTGTAGAAAATAACGTGGGACTGTTAACCATTGGGCTTGGACAAGGAAAGCTTAAG
ACTCGTCGAACAGGCTTTAAACCCTACAAAAGATGTTCCGTGGAGGCCAGGGAAAATAGGGTTGGA
GCGAACTGTGAAGAGAAAGGTTGTAAGAGAATACGTTTGGAAGGGGATACTTCGACTTGA SEQ ID NO: 90, CAD12767.2, LHY protein [Phaseolus vulgaris]
MDAYSSGEEVVVKTRKPYTITKQRERWTEEEHNRFLEALKLHGRAWQRIEEHIGTKTAVQIRSHAQ
KFFTKLEKEALVKGVPIGQALDIDIPPPRPKRKPSNPYPRKTTIGTATLHSGAKDGNLVESSHNNQ
ALDLEKEPLPEKYDLDEGLTTVKENKDENCSKVFKVIQEVPCSSISSANRSSISMSVPLGNSCVLK
EITSSVKEVITRDENTESFLTVELGNRNLEINDGKQANGTSKNSTLENSDALQTKLVQNEKTDGLD
SALTIDGMQGNQNYPRHVTVHVVDGKLGTSTQNPSQDMLFRDSMFQPIGGDNGQPNLFTNSAPTNT
SESQNNTARSSVHQSFLPYPPFTQHNQDDYQSFLHMSSTFSNLVVSTLLQNPAAHVAASFAATFWP

FIGURE 4 (continued)

YANPETSADSPRCSQGGFTSRQIGSPPSVAAIAAATVAAATAWWAAHGLLPLCLPLHAAFACPPAS
VTAVPSMNPPVQDQKHPEYSEAPQAQHSDSKSLAVISSDSETGNAKLNTSPKATDHVTNETISEHL
DSDKTKGRKQVDRSSCGSNTASSSDVETDALGKDEKGKEEPETPDANNLAIEFSNRRRSIYNLTDS
WKEVSSEGRLAFQALFSREVLPQSFSPPHALKNKDQMDITNDYKQNIADRNEDLDSKKCSSNALHK
IPSFVENNVGLLTIGLGQGKLKTRRTGFKPYKRCSVEARENRVGANCEEKGCKRIRLEGDTST

SEQ ID NO: 91, DQ822977.1, Glycine max MYB transcription factor MYB114 (MYB114) mRNA, partial cds
GTTTCTTCCTCCGATCCCTCATTGCCGCAAATGACTCCTCCTGCTAGTGTTAGGTGAATTCCCTCG
CTTCACATGCATGATCGCACCTTCAACTCTCTTCTTCTTCTTCTCCATGGCTTTTTTTCAAGG
TTTTGGCGCCGTGGAGTTCGTTTTGGTGAGGATTCTGATTAAAGAGTTTTCTTTTATTCTTTCGGA
GAAGCGTCTCTGTCTCTCTGTTGCGGTGGATTCTTAAAATTTGCTAAATCTTTTTTTTTCTTTTTC
TAATCTCTATTAGTATCATCCTGCGTGTGGCTTGTGATTGGAATGCTTAGATTTATATTTTTGTT
ACCAAACAGAGACGGATCTCTACCTTTCTATTTCTTTTGCAGTAGCATCACCGTATCATCAGCTTC
AGCTTGCTTTCACCAAAACGGCTTTACTATTGGTGTGTTCCATGTCACAAAAAACGAAAGGAGAT
ATTCCTTTTACCCACTCCTCGTCAGGGAAGATCTGAAGCAGCGCTAGCAGCACACGTCCTCTAATG
GACGCCGACTCCTCTGGAGAAGAAGTGGTTATTAAAACAAGAAAACCATATACTATCACAAAGCAA
AGAGAACGATGGACAGAGGAGGAACATAACAGATTTCTAGAAGCCTTGAAGCTATACGGGCGAGCA
TGGCAGCGCATAGAAGAGCATATAGGAACAAAGACTGCTGTACAAATCAGGAGTCATGCTCAGAAA
TTCTTTACAAAGTTGGAGAAAGAGGCCTTTGTAAAGGGTGTTCCAATAGGACAAGCTCTTGATATA
GACATCCCCCCTCCACGGCCAAAAAGAAAACCAAACAATCCTTATCCCCGGAAGACCAATGTTGGT
GGTGCCCCAACATTACATAGCGGAGCAAGGCATGGAAAGCCTCTCATTTCAATTGTATCTTCACTT
GGTAAACAAGCATTGGGCTTGGAGAAAGAACCCCTTCCAGAGAAGCATGATGTCGACCTAAGGCCA
TCAACCGTAAAAGAAAATAAGGACCAAAGCTGCTCAAAAGTATTTA

SEQ ID NO: 92, ABH02918.1, MYB transcription factor MYB114 [Glycine max]
MDADSSGEEVVIKTRKPYTITKQRERWTEEEHNRFLEALKLYGRAWQRIEEHIGTKTAVQIRSHAQ
KFFTKLEKEAFVKGVPIGQALDIDIPPPRPKRKPNNPYPRKTNVGGAPTLHSGARHGKPLISIVSS
LGKQALGLEKEPLPEKHDVDLRPSTVKENKDQSCSKVF

SEQ ID NO: 93, AY371287.1, Mesembryanthemum crystallinum circadian clock associated1 (CCA1) mRNA, complete cds
GGGGGTGTGGCGCATTTTCTCTCTCCTCGCGCTCGAGTTCAAACACTCCTGTTCTTCTTCAATTCC
TTTTTAGTGTTTTTTTTGAGAGGTTTAATCAATATACTAGAAATTCGGCAATCAAATGGGGTGAGT
TTATTCTGTCAATCATTTGTATGATCATTTAGTGGATTGAGCGTTCGATTGATTGTTTCTCGTCTT
CTCGATCTGCTATGGCATCTTCAGAAGGTGTGAGCACGTTCTCGACTGTTTCGGTGAGGATTCTGA
ACAAGGAAATTTTTACCGCTTTCTAGAGCTGGATGGATTGTCAATTTGATTTGGGAAACATGGGGG
AAGAAAGGGAGTCTTTTCATTTTTATGACGATTAGTTAGGTTTCAGTATATGAAATTTTATTATT
TTTGTTTTGGAAATGGTTGTTTAAATTGATAGTATTATTTGGGCGACAAAAAAGACAGGATCTCTA
TCGATTTTAGTTTTCTTGGTTTGCTACTTGTTTGTATTTCTGCAGTAGTGATTTACTCACCAGAT
TTCAACGAGTGTATGTTCAGTACTACTCTCTGATGTGTGGAGGGATAAGAGGCCGCTTTTGTATAC
CTTGCTTGTTGGAGAGCAGCTGAAAGCAGTGGTAGCGGTAGCTCCGGCTACCGCTATGGAGGCTTA
TTCTTCCGGAGAAGAGCTAGTTATTAAGACAAGAAAACCTTATACGATCACCAAGCAACGAGAGCG
ATGGACAGAAGAGGAGCATAATAGGTTTTTAGAGGCCTTGAAACTCTATGGACGAGCTTGGCAGCG
GATAGAAGAGCATATTGGAACAAAGACCGCTGTCCAGATCCGAAGTCATGCACAGAAGTTCTTTTC
AAAGTTGGAAAAGGAGGCTCTTGTTAAAGGTGTTCCAATACAGCAAGCAATCGACATAGAAATTCC

```
TCCTCCACGACCTAAGAGGAAACCGAGCAATCCTTATCCTCGCAAGACTGGAGCTGCAGGTTCTCC
AAGTACACAGATCAAAGTTAAGGATGGGAACAAAGTACCACCAGGTTCTTCACATACTGCAAACCA
GTTACTAGACTTGGAAAAAGAACCTCCACCAGAGAACACTACTGGTGATGATGGGAAGCAAAATGC
TAAAGAAACCTGTGGTGCTTACAAATGCTCAGAAACCTTTACTCTGTTCCAAGAAGCACCATCCAC
CTTGACAGCATCCGGTAATGAAAACTCTGCCATAACAACGGGTGCAACGAGAAAGTCATGCAAGGT
TGATGACCCTGTGCCAAAGAAACTGTTGGTCGATATTGACGGAAGTGATTGTCCTGCTGCTGATGG
ACGACAGAGAAATCAAAAACTAGATAAAACTGATACTGTGGAGACTGCTCAGAATGACACAGAAAA
CGAAATGCATGCTGTTAAGAACTTTCCTAGACATACTCCTGTTCATATTCTTGATGGAAGCCTAGG
AGCATGCAGTCAAGCTCTTTCCTCAGACGTATCATATCAAGAATCTGCATTTCATCGGATGGGAAT
CCCAGGCTATCCTGCAATTTTTAGCAATCCTGCAGTATCAGCTGCTGTGGAAAGTCAAAATAGCAC
ATCAAGAACCACTAATCAACAAATGTTTACAAGCTTCCATCCTCCATTTACTCCATTCCCTAACAC
CCCAGAAGACTATTCATCATTTGTGCAGATGTCTGCTACCTTTTCAAGTCTGATTGTGTCTGCTCT
TCTTCAAAACCCAGCTGCACATGCTGCAGCAAGTTTTGCTGCTTCCTTTTGGCCTTGCTCTAATAT
GGAAAATTCAGCCAATTGTCCTGCTGGTCTAAGTGGCGGATTCCCACCACGGCCAATGAATACGGC
TCCAAGCATGGCAGCAATTGCTGGAGCCACAGTAGCAGCTGCTACTGCTTGGTGGGCAGCACATGG
TCTCTTGCCCTTATGTGCTCCTGTACATTCTGGCTTCAATTGTCCTCCTGCCTCTGCTAATGCCCC
ATTAACTAATGTTGCCCAAAGTCAAGCCACTAATAAGGAAAGAGAGGAGAACAATTTCCAAAATCC
TGGTTCACAAGTTCAGCAACCTGATCAGGAACTCTCTGAAGCTTTGCAGCCACAGCATTCAGCATC
CAAACCTTCAGCAACATCGTCATCTGATTCTGGTGACAGTGCAGGTGCAAAGATGGAAATTGAAAT
ACCAACCAATGATAATGAGATAAAGGTCCCTGCAATGACTGAGCAAAAGGACTCAAGCAAGGGCAA
GAGCAAGAAACTGGTGGACCGCTCTTCTTGTGGTTCCAACACACCCTCAGGTAGTGATGTTGAGAC
TGATGCTTTGCAGAAGAATGATAAAGGCAAGGAAGAACCCCTAGAACCTGATATTAGTCAAATTGC
TGGTGAACTTAATAATCGTCGCAATCGAATTGCAAGCAACAACTTAAATGACAGCTGGAAGGAGGT
TTCCGAGGGGGACGCCTTGCGTTTCAAGCACTTTTCTCTAGAGAGAGATTGCCCCAGAGCTTTTC
ACCCCCACAAGACGTAAGTATTATGGACCAGGTAATGAATAATGGTGTTGAGAGAAATGGGCAAAA
TGCAACAGAAACCAATGAAGATGCATCACAGTTAGATCTCAACAGCAATACATGGGAATCTTGTTC
AGGTGATCAAGGGCACCTAGAGAACACTGGATTAAGAGAGAAGGAAAATGGAAAAGATCACTTCCT
GTCAATTGGTCTTGCTCAAGGGAAGCCAAGGGACCGTAGAACAGGTTTTAAGCCGTACAAAAGGTG
CTCTGTTGAAGCCAGGGAGAGTAGGTTGAACTCAAACAGTCAAGACCAAGAAAAATGTCCCAAGAG
AATACGCTTGGAAGGGGAGGCTTCAACGTGATATCAGATTATGCTTGCGTTTTGTGCTAGGGAAAC
CTTGGCCACAGCAAGTATACCCCATTTATTTTTAGTTTCTTTATTTCACTTAGCTTTATTTAAGTT
CTTAAAAGCTCACGAGACTTTTCGTGTTGTGTGTACTATAACTGACTAAATTGGTCTTTCATTTTT
CATCCTTCGTGTTAT
```

SEQ ID NO: 94, AAQ73524.1, circadian clock associated1 [Mesembryanthemum crystallinum]

```
MEAYSSGEELVIKTRKPYTITKQRERWTEEEHNRFLEALKLYGRAWQRIEEHIGTKTAVQIRSHAQ
KFFSKLEKEALVKGVPIQQAIDIEIPPPRPKRKPSNPYPRKTGAAGSPSTQIKVKDGNKVPPGSSH
TANQLLDLEKEPPPENTTGDDGKQNAKETCGAYKCSETFTLFQEAPSTLTASGNENSAITTGATRK
SCKVDDPVPKKLLVDIDGSDCPAADGRQRNQKLDKTDTVETAQNDTENEMHAVKNFPRHTPVHILD
GSLGACSQALSSDVSYQESAFHRMGIPGYPAIFSNPAVSAAVESQNSTSRTTNQQMFTSFHPPFTP
FPNTPEDYSSFVQMSATFSSLIVSALLQNPAAHAAASFAASFWPCSNMENSANCPAGLSGGFPPRP
MNTAPSMAAIAGATVAAATAWWAAHGLLPLCAPVHSGFNCPPASANAPLTNVAQSQATNKEREENN
FQNPGSQVQQPDQELSEALQPQHSASKPSATSSSDSGDSAGAKMEIEIPTNDNEIKVPAMTEQKDS
SKGKSKKLVDRSSCGSNTPSGSDVETDALQKNDKGKEEPLEPDISQIAGELNNRRNRIASNNLNDS
WKEVSEGGRLAFQALFSRERLPQSFSPPQDVSIMDQVMNNGVERNGQNATETNEDASQLDLNSNTW
ESCSGDQGHLENTGLREKENGKDHFLSIGLAQGKPRDRRTGFKPYKRCSVEARESRLNSNSQDQEK
CPKRIRLEGEAST
```

FIGURE 4 (continued)

SEQ ID NO: 95, BT012912.1, Lycopersicon esculentum clone 114030R, mRNA sequence

```
AACATGGCTTTCTTCGAAGGTTTAGGCATCATGCGGTTCGTTTTGTAGTGTTACATTATCAGGTTC
TTTTGTACAACACCACGGATAGACTATATTTGATAGTAACTGATGTTGTGGGGAGAATCGGAAGAA
GATTTGTTCTGTATCCCCTGTTTGTCCCTGAGGATTTGAAGCAGAGATAGCTAGCTTTGGTTCCTT
TATTTTGATGGACCCTTATTCCTCAGGGGAGGAACTTGTTGTTAAGACAAGGAAACCTTATACAAT
CACTAAGCAACGAGAGCGATGGACGGAGGAGGAGCACAATAGGTTCCTAGAAGCTTTGAAACTTTA
TGGGCGTGCTTGGCAGCGCATAGAAGAACACATAGGAACTAAAACTGCTGTGCAGATCAGAAGTCA
TGCGCAAAAGTTTTTTACAAAGTTAGAAAAGGAGGCTCTTACAAAGGGGGTCCCAACAAGTCAAGC
ACTTGACATTGAAATTCCTCCTCCACGACCTAAAAGGAAACCAAGTAATCCTTATCCTCGTAAGAC
AAGCGCAGCAGGTCACTCATCACAGGTGGGAGCAAAAGATGGGAAATATTCGACAACTTTTTCTTC
CATCTGTGAGGAAAGGAACTTATTTGACCTGGAGAAAGAACCGATTACTGAGAAACCTGGCGGAAA
CGAGAAGCTGGGCAATGTAAAAGAAACCCAGAACAAGAAAAACTGCTCCCAAGGGTTAACTAAGGA
AGGTGCTTCTGCAGCCTCTATGTCTTCAGGAAAGTCCTTGCAAGCACATGTGGCACCTACAGATGT
GTGTGCCTTTAGTGAGTCTGTGTCTGTCACCAAAGGAGTGGTTAACAATGATAACGCAAATAAATC
TTTTCTCATTGTTGAATCCAAAGAACATCAACAGTCAGAAATACTCGATATCAGACAGTCCTTTCA
AGGTAACAGCTCCTGTAACACCTTTGACGGGGGGAAATCTTGCCAGTCGAGTGAAAAGTTGGCACA
AGGTGAGAAAAAACATCCATCGTTTCAGCCAAACCATTTGGGGGAATTCTCAAGAAATGATATGCA
AGTGCTACACAACTATCCAAGACATGTGCCAGTGCATATTCTTGATGGAACAAATGGTTCTCAAAT
AGCCCCAGATATGTTTAATCATGAATCTACGAGTCAGCAGATAAATGGGGTCCCGGGGCTCCCAAA
TTTGTATTCTAACCCTGCTTCATCCACCACATCTGAGCACCACAGTAACGCTCCACAGTCATCCAT
TCATCAGTCATTTCTTGTTTCCACCCCATTTTCACCCCTATTCGTGATCCAGATGATTACCGATC
GTTTTTTCAATTATCCTCCACCTTCTCCAGCCTTATTGTTTCTGCTTTATTGCAAAACCCAGCAGC
ACATGTCGCAGCAAGTTTTGCCGCTAGCTTTTGGCCTTATGCAAATATGGAACGTCCAACGGATTC
TCCAACTGATAACACCGCTAGCCAGATTAACTCAGCTCCTAGTATGGCAGCAATTGCTGCTGCCAC
AGTAGCAGCTGCAACTGCATGGTGGGCAGCCCATGGGCTCTTACCATTGTGCTCTCAATTTCAAAG
CAGTTTTACCTGTGTTCCTACATCAGCAACATCAATGCAAGTGGATGCCTGTCAACCTAGAGTAGA
CAAGAACGAAGGAAGAGAGGGAACTCATGATTCTCCCCATGTTCAGGAACCTGTCCCAGAATGCTC
TGAAGCTTTGCAAGAACAACAATCAGGTTCTAAGTTGCCACCTTCTCTATCATCAGAATCGGAGGA
GAGTGAAGGTAGGAAGCTAAAAACTGGGTTAACGGCCACTGATACTGAGCAAGGAGCTGCAGTTAC
TAAAATTAATGAGCCAAACGCAGAAAAGGGCGGGAAGCAGGTAGATCGCTCTTCCTGTGGATCCAA
CACACCTTCAAGTAGTGAAATTGAGACAGATGCTTTGGAGAAGGATGAGAAAGGTAAAGAAGAGCC
CCAAGAATCTAATATTAACCTTCTAGCTGGAGAGGCTGCGAATCGGCGTTATAGAAATTTCATCAG
TCCAACCGAATCTTGGAAAGAAGTCTCCGAAGAGGGACGGATAGCTTTCCAGGCTCTTTTCACCAG
AGAAGTGTTGCCTCAAAGTTTTTCTCCTTCACTTGATCTGAAAAATAAGGGAAAGATCATTCTTGA
AAAGTTGAAGCAAAAGCCAGACGAGAAAGTTCAATGTGGACCGCAGTTAGATCTTAATGATATGGC
ATCCAATATCTGTTCCAGTCACCAAACAATGGAAGACAATGTGTTATTAATTGGCAACAAAGAAGA
TGTAGAAACATGCCTACCAATGATAGAACTTGGACAAGTAAGGTTGAAAGCTCGCCGTACTGGATT
TAAGCCTTACAAGAGGTGCTCATTGGAGGCAAATGATAGCAGGGTGACAAGTTCTAACTGTCAGGA
TGAAGAAAAAGCTCGAAAAGACTTCGGTTGGAAGGAGAAGCTTCTACTTAGTGTTGTATCAATGT
GCAATTCTACGAGGGAACCTGTGTTGTTGCACGGAGAGCTCTATTCTATCCTGTTATTATCTTTTC
CCAGTTACGTTGTCTAGTTCTAATGTACACGAAACTTGTCGTGTAGGTGTGTACCATATTATTTTT
ATGTTCTCTTTTAATTGGACTTGTATGCAAGGGACTTTGAAGTATGAACCTAAATGTGGATGTCTT
CAACAATCATAGCAAAAAAAAAAAAAA
```

FIGURE 4 (continued)

SEQ ID NO: 96, BT012912.1, Lycopersicon esculentum clone 114030R, deduced protein sequence
MDPYSSGEELVVKTRKPYTITKQRERWTEEEHNRFLEALKLYGRAWQRIEEHIGTKTAVQIRSHAQ
KFFTKLEKEALTKGVPTSQALDIEIPPPRPKRKPSNPYPRKTSAAGHSSQVGAKDGKYSTTFSSIC
EERNLFDLEKEPITEKPGGNEKLGNVKETQNKKNCSQGLTKEGASAASMSSGKSLQAHVAPTDVCA
FSESVSVTKGVVNNDNANKSFLIVESKEHQQSEILDIRQSFQGNSSCNTFDGGKSCQSSEKLAQGE
KKHPSFQPNHLGEFSRNDMQVLHNYPRHVPVHILDGTNGSQIAPDMFNHESTSQQINGVPGLPNLY
SNPASSTTSEHHSNAPQSSIHQSFSCFHPIFTPIRDPDDYRSFFQLSSTFSSLIVSALLQNPAAHV
AASFAASFWPYANMERPTDSPTDNTASQINSAPSMAAIAAATVAAATAWWAAHGLLPLCSQFQSSF
TCVPTSATSMQVDACQPRVDKNEGREGTHDSPHVQEPVPECSEALQEQQSGSKLPPSLSSESEESE
GRKLKTGLTATDTEQGAAVTKINEPNAEKGGKQVDRSSCGSNTPSSSEIETDALEKDEKGKEEPQE
SNINLLAGEAANRRYRNFISPTESWKEVSEEGRIAFQALFTREVLPQSFSPSLDLKNKGKIILEKL
KQKPDEKVQCGPQLDLNDMASNICSSHQTMEDNVLLIGNKEDVETCLPMIELGQVRLKARRTGFKP
YKRCSLEANDSRVTSSNCQDEEKSSKRLRLEGEAST

SEQ ID NO: 97, DQ822982.1, Glycine max MYB transcription factor MYB186 (MYB186) mRNA, partial cds
ACGAGCAGAGACGGATCTCTTCCTATTGTTCTCGCTTTGTTTCTTTTGCAGTAGCATCATCATCAT
CACCATACCTTGTTCAGATTCTGCTCACTTTCACCACAACGGCTTTACTATTTACCGCGTTTAGTT
TTCGTGTCACCGCAAATAATGAAAGGAGGTGTTCCCTGTATCCACTCCTCGTCAGGGAAGATCTGA
AGCAGTGCTAGCTGCTCACGTCCTGTAATGGACGCATACTCCTCCGGCGAAGAAGTGGTTGCTAAG
ACTAGAAAACCATATACAATCACTAAGCAAAGGGAACGATGGACAGAGGAGGAGCATAATAGGTTT
CTAGAAGCTNTGAAACTACACGGGCGACCATGGCAGCGCATAGAAGAGCATATAGGAACAAAGACT
GCCGTGCAAATAAGGAGTCATGCACAGAAGTTCTTTACAAAGCTGGAGAAAGAGGCCCTTGTAAAG
GGTGTTCCAATTGGACATGCTCTTGATATAGACATATCCCCTCCACGGCCCAAA

SEQ ID NO: 98, ABH02923.1, MYB transcription factor MYB186 [Glycine max], partial sequence
MDAYSSGEEVVAKTRKPYTITKQRERWTEEEHNRFLEAXKLHGRPWQRIEEHIGTKTAVQIRSHAQ
KFFTKLEKEALVKGVPIGHALDIDISPPRPK

SEQ ID NO: 99, AB210850.1, Lemna gibba LgLHY H2 mRNA for LHY homologue2, complete cds
CTAATACGACTCACTATAGGGCAAGCAGTGGTATCAACGCAGAGTACGCGGGGGTTCGTCCAGGTG
CACTTCAAAAAACTTCCTTCCTTCTCCATTCGACCATTGAGGTCTCGCCACGTGGATCCGATTCG
CCTTTCGAAAGATTTTCCAGGCCGAGAAATCTCCTCGCGGATGGAGTGGCGGAGAGCTCTCCAGAA
GGTGACTTCTGGCTGGATTTAGCTGGTAATCAACCACTACAGTAAGTTCCTTCTCTGCTCCCTCCG
CCGGCGGATCACCGGATTCCGTCTATTAGGTGAAAGCCGTCCGGATCCGTGGAGGAGAAGCGGCCA
TGAGGAAGAAGAAGCGGAGGGATCCGGAGAGCTTTTTCCGTTTTAAGTTCTTGATTGAAGGTTGC
GCCAAGGTCTGTGCCTTTTATTTTCCTAAATTGTTTTCCCTCGAGGTTCTGCAGGATGATCCGGC
CGCGGTATCCAAGGCGCGAGGTGAAATGAATCTCTACGTTTCGAATTGATTTATCGATGGTGTTT
GGAAACGAGTTCTTCAGGTCGAACGTCTGATCGAAGACCTCGTGGTTGAAGATCTGCGGTAGAGAG
AATTCCCGATCCTCTCGGCTCTGCGAAATGGATGCAATCTCCTCCGGAGAGGATTTCATTTTAAAG
ACAAGGAAACCGTATACGATAACGAAGCAGCGGGAAAAGTGGACTGAAGAGGAGCACAGAAAATTC
CTGGAGGCTTTGAAACTCTATGGCCGATCTTGGCAGCGCATTGAAGAACATATCGGCACTAAGACA
GCTGTTCAAATAAGGAGTCACGCTCAGAAATTTTTCTCTAAGCTTGAAAAGGAAGCGGTAATCAAA
GGCGTTCCCTTAGGACAAGCTCATGGCATCGAGATCCCTCCACCCCGCCCCAAGCGCAAGCCTAAC

```
ATCCCCTACCCTCGAAAAATCTCCTCCGACATTGATGGGTCTCACCAGAAGGTGGCATCCGACGAG
GACAAGTGCTTCATGGGCCTTGCGCTCTTTCAAGACTCGCCTTGCACGACAAAGCCCAGTTCGGAT
GTTGACCTTGGTAGATTCGAGGGCCTCAGCATTGATTCTTGTGTTAGGAAAGGAGACGCAAAGTCA
ACTTCCCACGGCGGCTCCATGTCAGGGGTCACGAGAGATCAACACAAGGCGAAGTCTATGCCATTC
GCCGCCTCCGACTTCTCCGCATTCTTCAACCTGTCCGCACAGTTTTCAAACCTTGTCATCTCAACC
CTGTTGCAGAATCCAGCCGCCCACGCGGCTGCCACGCTGGCAGCTTCATTCTGGCCTGCTGCTGGC
ATGAAGACTTCCACGGGTACCACGCCAGACAATCAGACAAATCCAACCCCAAGCATGGAGGCAATC
GTAGCCGCCACGGTGGCGGCCGCATCAGCATGGTGGGCCGCCCATGGATTATTACCCCTTTGTCCT
CTGGCAGGGTTATTCCCGGGTATCTCTGCATTCTCTCCGGGCCCGAAAGTGGAAGAGGCGGCAAAC
CCAAGATCAAAGTCAATGCCTTCGTCATCCGACTCCGACGAGCTGAACCCAACAAAGCAGGTGAGT
TGTAGTAAACCAGATGAATCTGGAAGAGAAGAAGAAGGCGGACCGATCCTCTTGTGGCTCCAAC
ACACCTTCCAGCAGCGATGTGGAGACGGACGTTGTATTGGACCTTGAAAAGGAGGACCTTCATCTG
GGCCTGGCCTACTCGGCTTCCTGGAAAGAAGTCTCTCACCAGGGTCGTGAGGCGTTTCAAGCACTG
TTCAATCGAGAGGTGCTGCCGCAGAGCTTCTCGCCCCCCAAGGAAGAGGAAGGCCGGCCAAGCCG
CGGCGAACCGGGTTCAAGCCCTACAAGAGGTGCTCCGCGACCCCGACCCACGCTTCCGGCGAAAAC
GACAGGAAGAGAATACGCCTCCAGAACGAGCCCTCACTCTGAAATCTTTCATTAGTGGAATTTCTC
GACTACATTTATTTATCCTTATGTTTTCTAGAAAGAGAACTCGCCGAGCAGCGGTGAAGATGGGAT
TCTATGCAGGCGATGTACCAAAGTATTCTCTGCTGGTCGGCGTATGAGAGAGAAAATGGAGGACTC
AAGGGCAGAGATGGACCTTCTCTTACAAGGAATGAGAAGAGAATGACAGCATTAGAATATTCCACT
ATAGCACTATCCAAGTTTCCCNAGAATTCATCCACCTGNAAATAATTAATTAAAATAANTATTATC
ACCATTTTTTTATTTCGTAANNNNANAATAAGCGCTGNNNNNAGG
```

SEQ ID NO: 100, BAD97871.1, LHY homologue2 [Lemna gibba]
```
MDAISSGEDFILKTRKPYTITKQREKWTEEEHRKFLEALKLYGRSWQRIEEHIGTKTAVQIRSHAQ
KFFSKLEKEAVIKGVPLGQAHGIEIPPPRPKRKPNIPYPRKISSDIDGSHQKVASDEDKCFMGLAL
FQDSPCTTKPSSDVDLGRFEGLSIDSCVRKGDAKSTSHGGSMSGVTRDQHKAKSMPFAASDFSAFF
NLSAQFSNLVISTLLQNPAAHAAATLAASFWPAAGMKTSTGTTPDNQTNPTPSMEAIVAATVAAAS
AWWAAHGLLPLCPLAGLFPGISAFSPGPKVEEAANPRSKSMPSSSDSDELNPTKQVSCSKPDESGR
EKKKADRSSCGSNTPSSSDVETDVVLDLEKEDLHLGLAYSASWKEVSHQGREAFQALFNREVLPQS
FSPPKEEEGRAKPRRTGFKPYKRCSATPTHASGENDRKRIRLQNEPSL
```

SEQ ID NO: 101, AY103618.1, Zea mays PCO118792 mRNA sequence
```
CCACGCGTCCGCTGCCTGCTCACTTCCGTTCCGTAGTCCAGCTAGATCCCCGGGCAACCGATCCAC
CGAGAAGCTTGTGGTTGTGGCGGCGGCGGAGAGGGAAGCGGGGAGCGGGAGGTCGGAGGCCTCCGT
GCGTCGGAGGTGGACGAGGGAGCGAGGCGGCGCCAGACCGAGGTTGCGTCGGGCTCGATTTCTACT
GGGCTGCTGTCTGCTGAGTTTACGGAAGTGTTTGGCCCTAGAAGAGTTGAAGATAAGGAGTGGAGC
TAGGTTTAAACTCTGGTGACTTGGTTGTTGTGTGCAACGAATCAACTATGCTGAGTTTTTCTGTAG
AGTAACAGAAATTGGATCAATTCAAGTAGAGGTCTAGGAGGAGATATGAGGTACTACTTGCGTCAG
GTCCAGCGTTTGGTTGGAGATATGGAAGGAGGAGCTCTCTTGTTTATAGACGACCTCAACTCCAAG
TGACAAAGCGAACAGCTGTTAACGTTTCCCTTCTATTTCTGTTTCTTTTTGCCGGATTTGGAGAT
GGAGGTGAATTCCTCTGGCGAGGAAACTGTGGTAAAGGTAAGAAAGCCGTACACAATAACGAAGCA
GCGGGAGCGGTGGACAGAGGCTGAACACAAACGGTTCCTTGAAGCCTTGAAACTTTATGGCAGAGC
ATGGCAGCGCATAGAAGAGCATGTTGGGACAAAGACAGCCGTGCAGATCAGAAGTCACGCTCAAAA
GTTCTTCACTAAGTTGGAAAAGGAAGCTATGAACAATGGTACTTCTCCGGGCAAGCCCATGACAT
TGACATACCTCCACCACGGCCTAAAAGAAAGCCAAACAGTCCATATCCTCGAAAAAGTTGTCTCAG
CTCCGAGACACAAACCAAAGAACTTCCAAATGACAAGTCAACAAAACCAAATATGCCCTTGAGCAA
TGGGCATGTAAAAATGGTAGGCGATGCATCTCTTCAGAATTTTCAAAGGAAGGAGTTGTCTGAAAA
```

FIGURE 4 (continued)

```
AGGAAGTCGCTCGGAAGTTCTTAATCTCTTCCGTGATGCCCCATCTGCATCATTTTCTTCAGTTAA
CAAAAGCTCTTCAAATCATGGGGCACCCAGGAGGACCGAGGCAAGTAAAACAGAAAGCCGAGATAT
GTCCATCATGGAAAATAATTCTTTTAACCCCAACACCCAAGAGGATGTAAAGGTGATCAGTGATCA
GGAAATGGAAAGGCTTAATGGTATCCAGATCAGATCTAAATGTGAACATTCTCATGAGGGGTATTT
GGACATCTCAACGCAACAAATGAAGCTAATGCCAAAGTCTGTGGAGACAACATATGTGGATGAACA
AACTGCAAGAGCTTCACACACCCTAGCAGAGAGCAACGGGGACAGCTAGCGTTCCAGTGACTGTAC
CTGAANGGACTCCATCCTGNTCAAACAAGTGNTCCAGTNGGGATCCATGGGAGCATGNACCCATGG
ATCCATCCCATGGT
```

SEQ ID NO: 102, AY103618.1, Zea mays PCO118792 deduced protein sequence
```
MEVNSSGEETVVKVRKPYTITKQRERWTEAEHKRFLEALKLYGRAWQRIEEHVGTKTAVQIRSHAQ
KFFTKLEKEAMNNGTSPGQAHDIDIPPPRPKRKPNSPYPRKSCLSSETQTKELPNDKSTKPNMPLS
NGHVKMVGDASLQNFQRKELSEKGSRSEVLNLFRDAPSASFSSVNKSSSNHGAPRRTEASKTESRD
MSIMENNSFNPNTQEDVKVISDQEMERLNGIQIRSKCEHSHEGYLDISTQQMKLMPKSVETTYVDE
QTARASHTLAESNGDS
```

SEQ ID NO: 103, AB210846.1, Lemna paucicostata LpLHY H2 mRNA for LHY homologue2, complete cds
```
CTAATACGACTCACTATAGGGCAAGCAGTGGTATCAACGCAGAGTACGCGGAAGCAGTGGTATCAA
CCCAGAGTACGCGGGAAATCTTCGCAAGAATCTAGTGGCGGAGAGCGCCGGCGAAATTCTGGCTGG
TATTTAGCTGGTCGTCGAGCTCCGGTGCCATTCTTTTTCGCCCCCATTGGCCGCGGCTTCAGAATC
GGGGAGAAAGGCGCCGCGGATCCGTGGAGGCAGTCATGAGAAAGAGGAAGAGGAGGAATTTGGGAT
GATTAATCCGTGCTAGTATTCCCGATCGTCTGATCTCTGCATTATGGATGTGAACTCCTCGGGAGA
GGACTTCGTCTTGAAGGCGAGGAAACCGTACACGATTACGAAGCAGCGGGAAAAGTGGACTGAAGA
GGAGCACAACAAGTTCTTACAGGCTTTGAAGCTCTACGGCCGATCTTGGCAGCGAATTGAAGAACA
CATCGGCTCTAAGACTGCTGTCCAAATTGGGAGCCACGCACAAAAATTCTTCTCAAAGCTTGAAAA
GGAAGCCCTCATCAAAGGTGTTCCCTTGGGGCAAGGCCAAGGCATCGAGATCCCTCCTCCCCGTCC
GAAGCGCAAGCCTAACAACCCATACCCTCTCAAAACCTCCATCTCTAATGGCATTGGCGGGCTCCA
CCAGAAGAAAGCTTCTTCAGATGAGGACTTATTGGGACTTTCACTCTTCCATGATCCATCCTGCAA
AACAAAGCCCAGCCCGGATGTTGAACTTGGCAGATTTGAGGGTCTCAGAATCGACACGAGTCTGAA
GAAAGGTGATTCAAAGCCAAAATCCATCAGCGGCACCACGTCGGGAACAACAACAGACCAGAATGC
TGAAAAGTCAATGCAATTGACCGCTTCTGCCTTCCCTCCATTCTTCAACATGTCAGCGGAGTTTTC
CAGCTTAGTAGTCTCAACCTTGCTGCAGAACCCAGCTGCCTATGCCACTGCAATGCTGGCAGCTTC
CTTCTGGCCACCTGCTGACGTAGACACTTCTTCGGATCCCGGATCAGACGGACGGATAAACCCCAC
TCCAAGTATTGCAGCCATTGCTGCTGCCACAGTGGCCGCCGCGTCTGCATGGTGGGCTATGCATGG
ATTATTACCATTTTGCCCCCCTGCAGGATTATTTCCTGGCGTCTTCCCCTTGGCTCCGAGCCTGAC
AGTGGAAGAAGCTGGTCAAAGGTCAAAGTCAATTCCCTCGTCTTCTGAATCCGACGAGCGGAATCC
AGCAAATGAAACGAATCGCGAGCCGGACGAACCCAGAGGAGAGAAGAAGAAGGCGGACCGGTCCTC
TTGTGGCTCCAACACGCCCTCCAGCAGCGATATGGAGACCAATGCTGTATTGGACCTTGAAAAGGA
GGACCTTCATCTTGGCCCGGCCCACTCTCCCTCCTGGAAGGAAGTCTCCCACCAGGGCCGTAAGGC
GTTCCAAGCGCTGTTCTCCAGAGAGGTGCTGCCGCAGAGCTTCTCGCCCCCGAAGGAAGAGGAAGG
CCGGTCTAAACCGCGGCGAACCGGGTTCAAACCTTACAAGAGATCCTCTGCATCCCCGGTTCATGC
TTCCAGTGAAAACGACGTAAAGAGATTACGCCTACAAAATGAGTCCTTCCCCTGAACTTGCTTATT
ATTGCTTTCTTGAAAAGAACTCCTTGAGCCTAACAGAGTAACGTGTATAAAAGTAGTCTCTGCTT
TGTTTACTTATGAAAGGATAATGAAGAATTTAACGGAATANNAAAAAAAAAANAANAAAAANAAAA
AAAAA
```

FIGURE 4 (continued)

SEQ ID NO: 104, BAD97867.1, LHY homologue2 [Lemna paucicostata]
MDVNSSGEDFVLKARKPYTITKQREKWTEEEHNKFLQALKLYGRSWQRIEEHIGSKTAVQIGSHAQ
KFFSKLEKEALIKGVPLGQGQGIEIPPPRPKRKPNNPYPLKTSISNGIGGLHQKKASSDEDLLGLS
LFHDPSCKTKPSPDVELGRFEGLRIDTSLKKGDSKPKSISGTTSGTTTDQNAEKSMQLTASAFPPF
FNMSAEFSSLVVSTLLQNPAAYATAMLAASFWPPADVDTSSDPGSDGRINPTPSIAAIAAATVAAA
SAWWAMHGLLPFCPPAGLFPGVFPLAPSLTVEEAGQRSKSIPSSSESDERNPANETNREPDEPRGE
KKKADRSSCGSNTPSSSDMETNAVLDLEKEDLHLGPAHSPSWKEVSHQGRKAFQALFSREVLPQSF
SPPKEEEGRSKPRRTGFKPYKRSSASPVHASSENDVKRLRLQNESFP

SEQ ID NO: 105, DQ822925.1, Glycine max MYB transcription factor MYB177 (MYB177) mRNA, complete cds
CGCGGATCCGCCAACCACAGAGGAGAAGATATTCACCACATGGCGATACAAGGCCAAAATGCATTT
ACTAGATCACAGGGTGGTCTTCCAATTGGAGATGAAATATCTTTCAATTCTGGTGTGCATTCTGTT
GCAGATATTCCACTACATGATCAGTTATCTTGTGGAAATGACTATGCCTTGAAGGTTAGGAAACCA
TATACTATCACAAAGCAGAGAGAGAGGTGGACAGATGAAGAACATAAGAAGTTCCTTGAAGCCTTA
AAGCTATATGGCAGGGCCTGGCGACGGATTGAAGAACATGTTGGCACAAAGACTGCTGTTCAGATT
CGAAGTCATGCTCAGAAGTTTTTTTCTAAGATTCTTCGAGAGTCTAGTGGGAACAGTACAACCTTG
GAGGAGTCAATTGAAATTCCACCTCCGCGACCAAAACGGAAGCCAATTCATCCTTACCCTCGTAAG
CTAGTTGAGTTTCCAAAGACAGGAATTTCCAACTCAGAACACCCACTGAGGTCTAATTCTCTGAAG
TCATCAGATTTTGGTCAAGAAAACAATTCTCCCAAGTCAGTTTTATCTACAGTTGTTTCAGAAACT
GTTGGTTCCTCCGATTCAGATACATCTAGTCGATGTTTGTCACCAGCCTCATCCATTAGTGGTGTC
CCCACAAACAGATTTCCACTTGCTGAGCCCAAAACATCATTTAAGGAAGAAGGGTCTGCACCAAGT
TCAGCTCATGATGAGCAACCTCCTGTGAAACTGGAGTTTCTTCACAAAGAAAGTGTTTCTACCAGA
GATGATGCAACAGAAGAATCATCTGGTCGTACTCTCAAACTTTTTGGGACCACTCTACTGGTAACA
GACACATGCAAACCTTCTTCCCCAACAACGGAGCCGTGCAAACCAACACCTGCGGCTGCAATGTAT
CTTATGCAACTTCAGAATGGATGTTCAGATGTTACAGAAGGTCATGCTTCTATTGTTCCTTGGTGG
ACTCTTCCCCACAATACTCCATTTATGCCACTGCACAAGGAGCCAAAAGGGAAGCATCTATATTCT
AATCTTGGAGAGTTTGAACATAAAGAAGTTCAAAAGGAAGGATCATGGACTGGTTCAAACACTAGT
TCAATTGATGATGGAGATAACACTGAAAAATCAGGTGATCAAGCCAAAAGTCATGTACATGGTTTT
AGCAAAAGTGAAACTTTAACTATATCTGAGCTAAGGGTGAGGCCTAAAACATGTGGAAAAGGGTTT
GTACCATATAAAAGGTGCATGGCAGAGAGGGAAAACCAGTGCTCATCAGTATATTATGAGGAAAGG
GAAGAGCAACGTATTAAGCTTTCCTTATAGTACCCTCTTATTGGCTTTTCTTCAAAGCAGTTTCCC
TTTTACAGGTATAATGTACCTGTTTCTGTTGCTGGATGACCTTGGGTACCCCG

SEQ ID NO: 106, ABH02866.1, MYB transcription factor MYB177 [Glycine max]
MAIQGQNAFTRSQGGLPIGDEISFNSGVHSVADIPLHDQLSCGNDYALKVRKPYTITKQRERWTDE
EHKKFLEALKLYGRAWRRIEEHVGTKTAVQIRSHAQKFFSKILRESSGNSTTLEESIEIPPPRPKR
KPIHPYPRKLVEFPKTGISNSEHPLRSNSLKSSDFGQENNSPKSVLSTVVSETVGSSDSDTSSRCL
SPASSISGVPTNRFPLAEPKTSFKEEGSAPSSAHDEQPPVKLEFLHKESVSTRDDATEESSGRTLK
LFGTTLLVTDTCKPSSPTTEPCKPTPAAAMYLMQLQNGCSDVTEGHASIVPWWTLPHNTPFMPLHK
EPKGKHLYSNLGEFEHKEVQKEGSWTGSNTSSIDDGDNTEKSGDQAKSHVGFSKSETLTISELRV
RPKTCGKGFVPYKRCMAERENQCSSVYYEEREEQRIKLSL

FIGURE 4 (continued)

SEQ ID NO: 107, BT009406.1, Triticum aestivum clone
wlm96.pk054.b21:fis, full insert mRNA sequence
CTCGTGCCGAATTCGGCACGAGCTCGTGCCGCGCCTCTTCGCCTCTCTTCTCTTCTCCTGCCTGCC
CCTCCCTCCTCGCGCTCCATCGACAACGAGCACCTCGTCTTGTTCTTGGTCTTGGCTTTTGGTGTG
GCGACGTTGGGTAGTGTGATTATCTTGTTCTCGCTGGCAGGAGATGGCCTGTACGCAGGAGAACGC
CATGGCAACCGACGAAAGCACGGCGGATCATCGCGGGAGTCGTCCGAGTTCCCACGACATGGATTT
ATCAGGGGATGACCACGTGCCAAAGGCACGCAAGCCGTACACCATCACGAAGCAGCGGGAGAAGTG
GACCGAGGAAGAGCACAAGCGCTTCCTGGAGGCCCTGCAGCTGCACGGCCGCGCCTGGCGCCGCAT
ACAAGAGCACATAGGCACCAAGACGGCAGTGCAAATCCGGAGCCACGCGCAGAAGTTCTTCTCTAA
GGTCACCAGAGAGTCGTCCGGGAGCTGCAGCGGCTCGGGCGCCGCGGCCGCGACGGCGACGGCGGC
GATCCAGATCCCCCCGCCGCGGCCCAAGAGGAAACCGACGCACCCGTACCCGCGCAAAGCGGACGA
CGGCGCGGCGGCCGGCGGTAAGCACGCCCCGGGGCTCACGCATCTGGAGAGGCCTCCCGTGCGGAT
GGGCGAGCAGGAGGAAGGGTCGCCGACGTCGGTGCTGACCGCGTCGCGGGTCGAGGCCTCCGGTGG
CCGCTTCTCCTACAACTCCAGCGGCAGCAGGTCGCCGGTTCCGTCGGCCGCCGGCTCCCTCTACGG
CTCGTCGGTGGACAGAGGGGACGGCTGCCTCTCGCCTAATACGACTAAGGCTTCAGAGTTCACTGC
AAATGGTGATGTCAAAGAGGGGTCATGTACAGGATCAGCGACATCAGTCCTTAAGCTATTCGGCAA
GAAAGTCGTGGTGAATGATTCATTCCAGAAGCCGAATACCAGCACCGGCAACCCGCAGAATGGTGG
CGACGTCGGAACTGAAGCTTCAGACGATACAACCACACAAGGAAGCAGAAACCTACCTTCTGGCGG
TGCCACAGAAGGAAGCTCATGGAATCCATGGCCGAGCAGCATGCAGCAGTTTGTGTATTTTGTTCC
TCAACCGGATGGTTTCGCCACACAATCTGCGGTGCCATGGTTTGGCACCCTGCCTGGTGCAATGTT
CTACCAGCAAGCCATGGCTCCAAATCAGCACCAGCGCCATCGCTCAGAGACCGCAGACCACAAGTT
CATGCAGAGGGAAGGATCCTGGACAGGATCAAACACTGGCCCTGGATCAGCTGCGCATAATTCAGA
TGCTGCCGACTCCCGAGGGAGAGGAAACAGCAGTGAGAGCGACAAAACGCCTGTGCCGCGGTTAAC
AAAGTGCGAGAGCTCTGTTTCGGTCAGTCTGCAAAGAGGTTTCATGCCATACAAGAGATGCGCGGC
CGAGAGCGAATCGCTGCGGTCGGAGGCGCCCAGAGAGGAGACCGACGGTGAGTTGACGAGGCTGTG
CTTGTGACAGCCGAAGATTCGACACGCTCTTCACAGTTTAGATGTTTGCTAGTTTTGCTCTAGACT
CTTGAGCTGGTGGTGTGATCTGCAGTGGGAAGAAGCGACCACTCATCCTGCTGGTTTTGCCTGTCG
GTATGTCGCACTTCTCCGAAGCAGCTCGAAGCCGCATTAGATTGAGCATTTCTGGTTCTTGCTCGT
GAATATATATAGTTGGAATATGTAGTATCCATGTTTTTGTTCTCTACAGAGTGTCTCTGCAGTTTT
TACCCCAAATCGGGAGGCTCAGAGTTCAGTGTTGTTGCCTGTATCAACCTGGGCCTGAGAGAGGGT
TGTCGTAGTCTTAACTGCATGTTGTAAGCTAGGCAGGCTTGTATCACTCTGTAGTCTGCATTCTGT
AAAACATATGATAGGCAGAAGACGAACAAAAACGTCGAATGCTCTGTATATCTAAAGTATAACATA
ATATAAAAAAAAAAAAAAA SEQ ID NO: 108, BT009406.1, Triticum aestivum clone
wlm96.pk054.b21:fis, deduced protein sequence
MACTQENAMATDESTADHRGSRPSSHDMDLSGDDHVPKARKPYTITKQREKWTEEEHKRFLEALQL
HGRAWRRIQEHIGTKTAVQIRSHAQKFFSKVTRESSGSCSGSGAAAATATAAIQIPPPRPKRKPTH
PYPRKADDGAAAGGKHAPGLTHLERPPVRMGEQEEGSPTSVLTASRVEASGGRFSYNSSGSRSPVP
SAAGSLYGSSVDRGDGCLSPNTTKASEFTANGDVKEGSCTGSATSVLKLFGKKVVVNDSFQKPNTS
TGNPQNGGDVGTEASDDTTTQGSRNLPSGGATEGSSWNPWPSSMQQFVYFVPQPDGFATQSAVPWF
GTLPGAMFYQQAMAPNQHQRHRSETADHKFMQREGSWTGSNTGPGSAAHNSDAADSRGRGNSSESD
KTPVPRLTKCESSVSVSLQRGFMPYKRCAAESESLRSEAPREETDGELTRLCL FIGURE 4 (continued)

SEQ ID NO: 109, DQ822922.1, Glycine max MYB transcription factor MYB173 (MYB173) mRNA, complete cds
ACGAGAGAAGATCTTGATTCTTGACAAGAGATTGTTTCTTCTGCAGCTATGGCGATTCAAGATCAA
AATGGATTTTTCAGATCACAGGGTGGTCCTCCAGAAGGAGGTGGTGTATCTTTGAGTTCTGGGCAT
TCTGTCACACATATTCAACTTAATGACCAGTTTTCTTGTGGGAATGACTATGCTCTGAAGGTAAGG
AAGCCGTATACTATCACTAAACAGAGAGAGCGATGGACAGATGAAGAACATAAGAAGTTCCTTGAA
GCTTTAAAGCTGTATGGACGGGCTTGGCGACGTATTGAAGAACATGTTGGCACAAAGACTGCTGTT
CAGATTCGAAGTCATGCTCAGAAGTTTTTTTCTAAGGTTCTTCACGATCCTACTGGGAACAATACA
AACACAGTGGAGTCAATTGAAATTCCTCCTCCAAGACCGAAACGAAAGCCGATGCATCCTTACCCT
CGTAAACTAGTTGAGACCCCAAATAAGGAAATTTCGATCCCAGAACAACCTATGAAGTCTAATTCT
CTGAAGTCGTCAGACTTTGATCAAGAAAACCAATCTCCAAAATCAGTATTATCAGGAGTTGGTTCA
GACAGCCTTGGCTCCTCTGATTCAGACACACCAAATGGAAGTTTGTCGCCCATGTCATCCATTAGT
GGCTTCCATACAAGCAGTTTTACACGTGCCAAACCCAAAACAACAACATCTGAGGAAGAAGCTGGG
ATGGACACTGATTCAACTCATGATGAGAAACCTCTTATGAAATTCAAGCTTCCTCCAAATGGATGT
GTTTCCATCAAAGAAGACAACACAGCAGAAGAATCTTCCGGTCGGACTTTCAAACTCTTTGGAATG
ACTCTATTTGTAACAGACACCTGCAAACCATCTCCAACAATCGAGGAATGCTAAAGATACCTCTAA
ACATTCGCGCGCAACGCCTTTCCTCCTCCATGGAGGATGGCAAATTGGAACTTGTTGGACACTCTA
GAGCAAGTGAAACATCAGCAATATCCAAGCTAAAGGTGAGAGTGGAACCTGAAGCATGTGGGAAAG
GGTTTGTGCCATATAAAAGATGCATATCTGTTGTGACAGCTGATGATAGAGAAGAGCAATGTATCC
ATCTTTCCTTGTAGCTTATACCCCACTGGATTTTTCCTTCAAAAAGTGTTCCCTTTGTCATGATGA
GCTGTAATGGTTGTTTTGGTTGCTGCTGGATGTGAGTTGGTATGATATAGGAAGGAAAAAGGGGTG
GCTGAAAATTTTGATATTTCCGTTGAATTGCACTGCACTGCACATTCTCCAGCTGTTCAAATCCGT
AAACTTGCCTTTTCTATTTTTTGACTTCCAAGTTTCAACACATTCTCCGCGGGTCCAAGCCGTGT
CTGTGCGCGGCACTTAGGAGCTGTGTCCGTGCTTCCTAGTTTAACTGTGAATAACTGTGAATTATA
TCTAGTGCCTTTTTTTAAAAAAAAAAAAAAAAAAAAAAAAAAAACTCG

SEQ ID NO: 110, ABH02863.1, MYB transcription factor MYB173 [Glycine max]
MAIQDQNGFFRSQGGPPEGGGVSLSSGHSVTHIQLNDQFSCGNDYALKVRKPYTITKQRERWTDEE
HKKFLEALKLYGRAWRRIEEHVGTKTAVQIRSHAQKFFSKVLHDPTGNNTNTVESIEIPPPRPKRK
PMHPYPRKLVETPNKEISIPEQPMKSNSLKSSDFDQENQSPKSVLSGVGSDSLGSSDSDTPNGSLS
PMSSISGFHTSSFTRAKPKTTTSEEEAGMDTDSTHDEKPLMKFKLPPNGCVSIKEDNTAEESSGRT
FKLFGMTLFVTDTCKPSPTIEEC

SEQ ID NO: 111, DQ822986.1, Glycine max MYB transcription factor MYB140 (MYB140) mRNA, partial cds
GTCTCTGTGGAGGTTTGGGTGTTTTTGAGGCAGAGCTTATTCTCATTTTGCTCCAATGGAGATGC
AGGACCAAATAGAAAGCACAAGATCAACCATATTTGGCTCAGCTAGTAACATCCATTCCAATGCTG
AAAAGCAGGCCGAAAATGTTGCTCCCAAGGTGAGGAAACCATATACCATTACTAAACAAAGGGAGA
AGTGGACAGAGGAAGAGCATCAAAAGTTCCTTGAAGCTTTGAAATTGTATGGTCGTGGCTGGCGCC
AAATTGAAGAGCATATAGGTACCAAAACTGCTGTTCAGATTCGAAGCCATGCTCAAAAGTTTTTCT
CTAAGGTTGTGAGGGAATCTGAGGTCAGTGATGAGGGTTCTATACAACCAATTAACATACCTCCTC
CTCGGCCTAAGAGGAAACCCCTGCATCCATATCCCCGTAAATCAGTTAATTCTTTCAGAGGACCCA
CCATACCAAATGAAACA FIGURE 4 (continued)

SEQ ID NO: 112, ABH02927.1, MYB transcription factor MYB140 [Glycine max], partial sequence
MEMQDQIESTRSTIFGSASNIHSNAEKQAENVAPKVRKPYTITKQREKWTEEEHQKFLEALKLYGR
GWRQIEEHIGTKTAVQIRSHAQKFFSKVVRESEVSDEGSIQPINIPPPRPKRKPLHPYPRKSVNSF
RGPTIPNET

SEQ ID NO: 113, DQ822983.1, Glycine max MYB transcription factor MYB131 (MYB131) mRNA, partial cds
TCATTTTCTCGGAAAATTCTTCTTTTCCGAGAAATTTCGCGTTTTTACTGTTGAATCGATAATTCA
CAAATCGGGGGTGTCTGAAATTCAAAGCTGTTGTTGTTGTTGGCTGCTGGGGTTAGTCTCTGTGGA
GGTTTGGGTGTTTTCTGAGGCAGAGCCGATTCTCATTTTGCTCCAATGGAGATGCAGGTCTCAATC
ATCTTACGTTCACTCTTCTGGAGACTTTTCTCCTCTTTTAATAGGAAAAAGAGAATTTCAATATG
AATTCATCCAGTGACTTTATTTCTAAGGAACTGAAATATATTCTAGACCAAATAGAAAGCACAAGA
TCAACCATATTTGGCTCAGCTAGTAACATCCATTCCAATGGTGAAAAGCAATCCGAAAATGTTGCT
CATATACCTTCTGTTGGAAACAACCAAACTCCCAAGGTGAGGAAACCATATACCATTACTAAACAA
AGGGAGAAGTGGACTGAGGAAGAGCATCAAAAGTTCCTTGAAGCTTTGAAATTGTATGGTCGTGGC
TGGCGCCAAATTGAAGAGCATATAGGTACCAAAAATGCTGTTCAGATTCGAAGCCATGCTCAAAAG
TTTTTCTCTAAGGTTGTGAGGGAATCTGAGGGCAGCGCTGAGAGTTCTATACAACCAATTAACATA
CCTNCTCCTCGGCCTAAGAGGAAACCCCTGCATCCATATCCCCGTAAATCAGTTAATTCTTTCAGA
GGACCCACCATACCAAATGAAACAGAAATATCTCCATCTACAAACCTGTTGGTTGCAGAGAAAGAC
ACCCCATCTCCAACCTCGGTGCTATCTACAGTTGGTTCGGAAGCATTTGGGTCTCAATTTTCAGAG
CAGACTAACAGATGCCTTTCACCAAACTCTTGCACCACTGATATTCACTCAGTCAGCTTATCACCT
GTTGAAAAGGAAAATGATTGCATGACATCCAAAGAATCTGAGGAGGAAGAGAAAGCATCACCAGCT
TCACGTCCTTTATCCACTGTTTCTAACCCAAAAATGTGCATGAAACCTGAGTTTAGTTCCAAGGAG
ATAGAAGATGCTACTGATATGCCACAAACCACTAGTATTAAGCTNTTTGGAAGAACAGTCTCTATG
GTAGGTAATCAGAAGTCAC

SEQ ID NO: 114, ABH02924.1, MYB transcription factor MYB131 [Glycine max], partial sequence
MEMQVSIILRSLFWRLFSSFNRKKENFNMNSSSDFISKELKYILDQIESTRSTIFGSASNIHSNGE
KQSENVAHIPSVGNNQTPKVRKPYTITKQREKWTEEEHQKFLEALKLYGRGWRQIEEHIGTKNAVQ
IRSHAQKFFSKVVRESEGSAESSIQPINIPXPRPKRKPLHPYPRKSVNSFRGPTIPNETEISPSTN
LLVAEKDTPSPTSVLSTVGSEAFGSQFSEQTNRCLSPNSCTTDIHSVSLSPVEKENDCMTSKESEE
EEKASPASRPLSTVSNPKMCMKPEFSSKEIEDATDMPQTTSIKLFGRTVSMVGNQKS

SEQ ID NO: 115, DQ822987.1, Glycine max MYB transcription factor MYB144 (MYB144) mRNA, partial cds
ACGAGAACTAGTCTCGAGTTTTTACTGTTGAATCGATAATTCACAAATCGGGGGTGTCTGAAATTC
AAAGGACCAAATAGAAAGCACAAGATCAACCATATTTGGCTCAGCTAGTAACATCCATTCCAATGG
TGAAAAGCAATCCGAAAATGTTGCTCATATACCTTCTGTTGGAAACAACCAAAACTCCCAAGGTGA
GGAAACCATATACCATTACTAAACAAAGGGAGAAGTGGACTGAGGAAGAGCATCAAAAGTTCCTTG
AAGCTTTGAAATTGTATGGTCGTGGCTGGCGCCAAATTGAAGAGCATATAGGTACCAAAAATGCTG
TTCAGATTCGAAGCCATGCTCAAAAGTTTTTCTCTAAGGTTGTGAGGGAATCTGAGGGCAGCGCTG
AGAGTTCTATACAACCAATTAACATACCTCCTCCTCGGCCTAAGAGGAAACCCCTGCAATCCATAT
TCCCCCGT

FIGURE 4 (continued)

SEQ ID NO: 116, ABH02928.1, MYB transcription factor MYB144 [Glycine max], partial sequence
MVKSNPKMLLIYLLLETTKTPKVRKPYTITKQREKWTEEEHQKFLEALKLYGRGWRQIEEHIGTKN
AVQIRSHAQKFFSKVVRESEGSAESSIQPINIPPPRPKRKPLQSIFPR

SEQ ID NO: 117, DQ822939.1, Glycine max MYB transcription factor MYB174 (MYB174) mRNA, partial cds
ACGAGGAAAGCCTTATACTATCACCAAACAGAGAGAGCGATGGACAGATGAAGAACATAAGAAGTT
CCTTGAAGCTTTAAAGCTGTACGGACGGGCTTGGCGACGTATTGAAGAACATGTTGGCACAAAGAC
TGCTGTTCAGATTCGAAGTCATGCTCAGAAGTTTTTTTCTAAGCTTCTTCGCGATCCTACTGGGAA
CAATACAAACACAGTGGAGTCAATTGAAATTCCTCCTCCAAGGCCGAAACGAAAGCCAGTGCATCC
TTACCCTCGTAAACTAGTTGAGACCCCTAATAAAGAAATTTTGATCCCAGAACAACTTATGAAGTC
TAATTCTCTGAAGTCATCAGACTTTGATCAAGAAACCAATCTCCAAAATCAGTATTATCAGGAGT
TGGTTCAGACAGCCTTGGCTCCTCTGATTCAGACACACCATATGGAAGTTTGTCGCCCATGTCATC
CATTAGTGGCATCCATACAAGCAGTTTTACACGTGCTGAGCACAAAACAACATCTGATGAAGCTGG
GATGGACACTGATTCAGCTCATGATGAGAAACCTCTTATGAAATTCAAGCTTCCTCCAAATGAATG
TGTTTCCATCAAAGATGACACAGCAGAAGAATCTTCCGGTCGGACTTTCAAACTTTTCGGAATGAC
TCTATTTGTAACAGACACCTGCAAACCATCTCCAACAATCGAGGCATGCAAACCGATACCTCTAAA
CATTCGTGTGCGATGCCTTTCCTCCTCCATGGGGGATGATGGCAAATTGGAACTTCGTGGCCACTC
TACAGCAAGTGAAACATCAGCAATATCCAAGCTAAAGGTGAGAGTGGGACCTGAAGCATGTGGTAA
AGGGTTTGTGCCATATAAAAGATGCATATCTGTTGTGACAGCTGATAATAGAGAAGAGCAATGCAT
CCATCTTTCCTTGTAGCTTACCCCACTGGATATTTCTTCAAAAGGGTTCCCTTTGAGATGATGAGC
TGTAATGGTTGTTTTAGCTGCTGGATGTGAGTTGGCATAAAATAGGGAGCTGAAAATTTTGACATT
TCTGTTGCATTACACTGCACATTCTCCAGCTGTTCAAATCCGTGAACTTGCCTTTTGTATTTTTTT
GACTTTCAAGTTTCAACTGTGAATTATATCTAGTGTTTTTGTTTGTTTTTTTTAAAAACTTTTTA
TGCTCCTTAAGAGTATGCAAAGTGTAAGTCACGTACTTGTGCAGTGCTTATTAACGTACTTGTTCA
TAGATTCTGCATTTACTACCATGATGGGAATTTTTTCTAACGA

SEQ ID NO: 118, ABH02880.1, MYB transcription factor MYB174 [Glycine max], partial sequence
RGKPYTITKQRERWTDEEHKKFLEALKLYGRAWRRIEEHVGTKTAVQIRSHAQKFFSKLLRDPTGN
NTNTVESIEIPPPRPKRKPVHPYPRKLVETPNKEILIPEQLMKSNSLKSSDFDQENQSPKSVLSGV
GSDSLGSSDSDTPYGSLSPMSSISGIHTSSFTRAEHKTTSDEAGMDTDSAHDEKPLMKFKLPPNEC
VSIKDDTAEESSGRTFKLFGMTLFVTDTCKPSPTIEACKPIPLNIRVRCLSSSMGDDGKLELRGHS
TASETSAISKLKVRVGPEACGKGFVPYKRCISVVTADNREEQCIHLSL

SEQ ID NO: 119, AY740076.1, Ostreococcus tauri LHY-like protein gene, partial cds
GGCGAGGCCCCATCGAGTAATGATACCGGTGATGAGGCCACGGTGACGACGAACGACGCCACGAGC
GATCCGACGACGACGGAGGGGAAGGCGGTGAAGACGCGCAAGCCGTACACCATTACGAAGAAGCGC
GAGCGATGGTCCGACGAGGAGCACGCGTTGTTCGTAGAGTCGTTAAAAAAGTACGGACGCGCTTGG
AAAAGGATTGAGGAGTACATTGGGACGAAGAGTGCGGTGCAAATTCGGTCGCACGCGCAGAAATTT
TTCGCCAAGCTACAAAAGGAGCAGATCGTCGCGAGCGGAAGCGAGGCTCTGGGAGCACGCGAAAG
CGTGGAGCGGATCGATCGACGTCGCAGAGCAAGAGAAGCAAGTCTAGCTATGCGACGGATATCAAT
CTTGAGATTCCGCCGGCGCGGCCTAAGAAGAAGCCGGCGCATCCGTACCCGAGGAAGGCGACGTCT
CAGCAGCCGAGCGGCGGAAGCGGAGAGCGAGACAACTCTGGTGGGACTGGTAAGAGCTCCGGTACG
GCGCAAAAGTGGCCTACCGAGGCGAGTCAGGAGTTTATCGCTAGTACGTCGTCGAGCGCCGCGATA

FIGURE 4 (continued)

```
GCAGCCGTGCTTTCGGTCGCTTGCGATAAGATGCAGAACAATTTGCATCAAGAGTTGCGGCAAGGA
TATTTTGGAATACCGACCGGCATGCAACCGCAGCAGGGAATGTTTGCCCAGCCTGGGATGTTTCCG
ATGAACGCGATGATGAGTCCGTTCGTGGCGATGAACACCGTCTCCGGCGCGCCGACACCGCCGCCG
ATGACCAATCCACAGCAATTTCTTAACTACGCCAACTTCTTCAGCAACTATTGGCCTCAGTTCGCC
AACGCCGCTAACGCCAACGCTGTGAATGTGATGTTCCAACAACAACAGCAACAGCAACAGCAACAG
CAACAACAACAACATAAACAGCGGGCGGGTGGTGAAACCAAATAA
```

SEQ ID NO: 120, AAU14271.1, LHY-like protein [Ostreococcus tauri] partial sequence
```
GEAPSSNDTGDEATVTTNDATSDPTTTEGKAVKTRKPYTITKKRERWSDEEHALFVESLKKYGRAW
KRIEEYIGTKSAVQIRSHAQKFFAKLQKEQIVASGSEGSGSTRKRGADRSTSQSKRSKSSYATDIN
LEIPPARPKKKPAHPYPRKATSQQPSGGSGERDNSGGTGKSSGTAQKWPTEASQEFIASTSSSAAI
AAVLSVACDKMQNNLHQELRQGYFGIPTGMQPQQGMFAQPGMFPMNAMMSPFVAMNTVSGAPTPPP
MTNPQQFLNYANFFSNYWPQFANAANANAVNVMFQQQQQQQQQQQQQQHKQRAGGETK
```

SEQ ID NO: 121, AC150443, Medicago truncatula chromosome 7 BAC clone mth2-71o19, join (95079-95123, 95226-95337, 95414-95586), partial sequence
```
ATGGATGCAGCAGCATACTCCTCTGGAGAAGACGTCGTTCTCAAGACAAGAAAGCCATATACAATC
ACAAAACAAAGAGAACGATGGACTGAAGACGAACATAATCGATTTCTAGAAGCCCTCAAGCTATAT
GGCCGAGCATGGCAGCGTATAGAAGAACATATAGGAACAAAGACTGCTGTGCAAATCAGGAGCCAT
GCGCAAAAATTCTTTTCAAAGGTCGATTGGTACCCTCTCTCACCTCCCAATTTATGCTCAAACTTT
TTCTTATTTCTATTGGGAAAAAACTCAAGTCCCACATCGGATATAAGACTCTTGATGGGAGTATAG
```

SEQ ID NO: 122, ABD32719.1, Homeodomain-related [Medicago truncatula], partial sequence
```
MDAAAYSSGEDVVLKTRKPYTITKQRERWTEDEHNRFLEALKLYGRAWQRIEEHIGTKTAVQIRSH
AQKFFSKVDWYPLSPPNLCSNFFLFLLGKNSSPTSDIRLLMGV
```

SEQ ID NO: 123, DQ074476.1, Malus x domestica MYBR5 mRNA, complete cds
```
TTTCAATTTAAAAAAAAACCAAGGGGAATCCGACTCTTCCGCAATTTATGGTATCCAAAAACCCGA
ACCCGCCAGAGGGCTTGTACTTGGATCCGAACGAAAGCGGCATGCCGTTGCCCGGACTCGGGCCGT
TCGCCTCGGCCACTGCGACGACGTCAACGACTTCGTCTTCGGCGGAGGATCTGAGCAAGAAGATTC
GGAAGCCCTACACAATTACCAAGTCCAGAGAGAGCTGGAGTGAGCCGGAGCACGACAAGTTCCTCG
AAGCCCTCCAACTCTTCGATCGCGATTGGAAAAAGATTGAAGCTTTCATTGGGTCAAAGACGGTCA
TACAGATACGTAGTCATGCACAGAAGTATTTTCTGAAGGTTCAAAAGAATGGGACGAGCGAGCATC
TACCTCCCCCTAGGCCAAAAAGGAAAGCTGCTCACCCATATCCTCAAAAAGCTTCAAAAAATGCTC
TGGCACTTCCGCCAGTATCTTGGTCATGTCAGTCTTCATCTGCTTTACTTGAATCTGGGTTTAATC
AAAGGCCAGATTCATCATCAATGCTTATGAGTCCTATCCCTGGCCCTGTAGCCCCTTCCTGGCCTA
ATGGTTCTGTGCAAACAGCCAATCCATCTCATGAGTCCAAAGTTGTTTCAGGGCCAACTGTGCTGA
CAACAGTTGCAGTACCACAGAAAGCACCCCTAAAGCTCAACCAGTTGGTGGAACAACTGATCAAG
TGAACCATAGCCATGCATTGAGAGTTCTTCCCGACTTTACTCAAGTATACGGATTCATTGGCAGCG
TCTTTGACCCTAATGTTACAGGTCATCTTCAGAATCTGAAGAAGATGGATCCGATAGATGTTGAAA
CGGTGTTACTGTTGATGAGAAACCTGTCCATGAATTTGACCAATCCCGAATTCGAGGATCATAGAC
AGTTGCTTTCATCCTACAAGATGGACGCGAATACAGGGAATCTCAGTGATGCAACTAAAACCCTTT
GCGACGATCAACATGAGAAAGTTCCTTAAGTGGTTGTTCTGAAACTTCAACGCTTTCTTCTCATCC
```

FIGURE 4 (continued)

```
CGTTGGCAGTGCTTGAATTTCGAATCTAATCTTTGCCCAACCGGTGTTGGCGTCCAGCAGATGAAT
TGCTGGGGGAAAACCTCAATTAGTAGAAAGCATCAGGTTTCATCTAGGTATTGACTCGTCGTGATA
CTGCGTTGTAAGTGTAGCGAGCTCAACGACCACAAGCATGTCAACTGGTATGGCGTTCTGGTGTGG
TTGTGTGTGTGTGTATATATATATCAAGATAAAGGTAATGGATTTTTGTATAGTTAGTTCAA
GTTCATCTTGTAAAAAAAAAAAA
```

SEQ ID NO: 124, AAZ20444.1, MYBR5 [Malus x domestica]
```
MVSKNPNPPEGLYLDPNESGMPLPGLGPFASATATTSTTSSSAEDLSKKIRKPYTITKSRESWSEP
EHDKFLEALQLFDRDWKKIEAFIGSKTVIQIRSHAQKYFLKVQKNGTSEHLPPPRPKRKAAHPYPQ
KASKNALALPPVSWSCQSSSALLESGFNQRPDSSSMLMSPIPGPVAPSWPNGSVQTANPSHESKVV
SGPTVLNNSCSTTESTPKAQPVGGTTDQVNHSHALRVLPDFTQVYGFIGSVFDPNVTGHLQNLKKM
DPIDVETVLLLMRNLSMNLTNPEFEDHRQLLSSYKMDANTGNLSDATKTLCDDQHEKVP
```

SEQ ID NO: 125, BT008954.1, Triticum aestivum clone wdk1c.pk011.f12:fis, full insert mRNA sequence, (196-1056)
```
GCACGAGCCCAACCCGGCCCCCGGCGCCACACCGCGACGCGACGCGACGCAGCCACCACGCAGGCG
GACGCGGCCGAGCTACGGACAAAAGCCTCCCTCTCCATCCCCCGGTCCAGCGAGCGAGAGACCGCC
ACCGGCACCGGCACCCAACGGGACCTGGCACGCCGCGCGCCCTCTGGCCTCCGTGCGTCCCCATG
GTCTCCACGAACCCGCCGCCGCCGCCGGCGCTGTCCGAGGCGGCCGCCGCCGTGTCGGGCGACGAC
GCCAGCAAGAAGGTGCGGAAGCCCTACACCATCACCAAGTCGCGCGAGAGCTGGACGGAGCAGGAG
CACGACAAGTTCCTCGAGGCCCTGCAGCTCTTTGATCGTGACTGGAAAAAGATAGAAGCTTTTGTT
GGTTCGAAGACTGTCATCCAGATAAGGAGCCATGCACAGAAGTATTTTTTGAAGGTTCAGAAAAAT
GGAACCAGCGAACATGTCCCACCTCCACGACCGAAGCGTAAAGCTGCCCACCCATACCCTCAGAAG
GCCTCCAAAAATGAGCCAGGATATGCCCTGAAGACAGATCCATCTGCCATGCTTAGAAATTCAGGA
ATGAACGTGGCTGTTTCTCCATGGACCCACAATTCTATCCCACCAGTTGTCGCCTCATCTTTCATG
AAAGAAGATTTAGGTGCTGGGTCTATGGGTCCAAACATTTTTGCTCAAGCAGTAGTGAAGGCCCT
CCAAGGGCATGGCAATCTGGTGAAACCAATGACCAGATAAATCAAGTTCCATCACTCCGCATTATG
CCAGATTTTGCACAAGTATACAGCTTCTTAGGCAGTGTTTTCGATCCAAGCACAAAGGGCCATTTG
CAGAAACTGAAGGAGATGAATCCAATTGATGTTGAAACAGCACTGTTGTTAATGAGAAATCTCTCC
ATCAACTTGACCAGTCCTGATTTTGAAGATCAAAGGAAGTTGCTGTCTTCGTACAATTCCACCTCT
GATGGGCTAGAGCTAGGGAGCTCCAGAAGCTCACTTCTTACGGATAATGCATTGAGCCTTTTTTGA
TAGTTCATGATTAAAGGCAGATGGTGCCGCCTATAGTTTCATCTCGATCTCTGAATAGGGGGTTTT
CCTGGAGCACCCATGAAGGCGCTTTCACCATTGTATTTCTAGCTAGCTTCGAACCGTAGAATGTGT
AAGGGTGCAACCATGTACAGTAGGCTTCCATAAGGTGAGATCTGTCTATAGCCTGATGTGTATATA
TTTTCGCCCCGAAGCGTGTATCTTTCCTCCCCCGATACCTTGGCCATCAAGGTGCATGGATGTTGC
TTCAGTCAAAGCTTGAAAGTGCTGTCCTTGGTGATGGTAAATGGAAAGGAAATTTTGAGTAATGCT
GGTTACTCCCTTTTCAAAAAAAAAAAAAAAAAA
```

SEQ ID NO: 126, BT008954.1, Triticum aestivum clone wdk1c.pk011.f12:fis, derived protein sequence
```
MVSTNPPPPPALSEAAAAVSGDDASKKVRKPYTITKSRESWTEQEHDKFLEALQLFDRDWKKIEAF
VGSKTVIQIRSHAQKYFLKVQKNGTSEHVPPPRPKRKAAHPYPQKASKNEPGYALKTDPSAMLRNS
GMNVAVSPWTHNSIPPVVASSFMKEDLGAGSMGPNIFCSSSSEGPPRAWQSGETNDQINQVPSLRI
MPDFAQVYSFLGSVFDPSTKGHLQKLKEMNPIDVETALLLMRNLSINLTSPDFEDQRKLLSSYNST
SDGLELGSSRSSLLTDNALSLF
```

FIGURE 4 (continued)

SEQ ID NO: 127, DQ822956.1, Glycine max MYB transcription factor MYB148 (MYB148) mRNA, partial cds
GTCGCTCCCCGGAATCCTTCCCTTCGCCGCCGCAGCCACCGCCACCGCAGATTCCTTTGAGGACCC
TGCTAAGAAGACTCGCAAGCCTTACACTATTACCAAGTCTAGGGAGAGTTGGACCGAACCTGAGCA
CGACAAGTTCCTCGAAGCTCTTCAGTTATTTGACCGTGACTGGAAAAAGATTGAAGCATTTGTTGG
ATCAAAGACAGTCATCCAGATACGTAGCCATGCTCAGAAATACTTTCTAAAAGTTCAGAAGAGTGG
GACAAATGAACATCTTCCTCCACCCAGACCAAAAAGAAAAGCTGCTCATCCATATCCTCAGAAAGC
TTCAAAAACTGGTTATAGTCTTCACTATATTTTTTTTTTTGCTACACAATTTAGTGCATTTGTCT
CTAATAATTGTTGGTGAGATTTGGCAGCTCCAGTACTCTCACAAGTATCAGGATCCTTTCAATCTT
CATCAGCTTTGCTTGAACCTGGATACATATTAAAGCATGACTCTTCAGCAATGCCTAAAACTCCCA
TTATTAACACTGCAGTGTCTTCCTGGTCAAACAACTCTCTGCAGAAAACCACCAGCGTATTGCATG
GGCAAAAACAAAAAGTGAATAATTGTTGCAGTAGCAGTA

SEQ ID NO: 128, ABH02897.1| MYB transcription factor MYB148 [Glycine max], partial sequence
SLPGILPFAAAATATADSFEDPAKKTRKPYTITKSRESWTEPEHDKFLEALQLFDRDWKKIEAFVG
SKTVIQIRSHAQKYFLKVQKSGTNEHLPPPRPKRKAAHPYPQKASKTGYSLHYIFFFCYTI

SEQ ID NO: 129, DQ822955.1| Glycine max MYB transcription factor MYB135 (MYB135) mRNA, partial cds
TAAACTTGGACCCCTCCGGCATGTCGCTCCCCGGAATCCTTCCCTTCGCCGCCGCAGCCACCGCCA
CCGCAGATTCCTTTGAGGACCCTGCTAAGAAGACTCGCAAGCCTTACACTATTACCAAGTCTAGGG
AGAGTTGGACCGAACCTGAGCACGACAAGTTCCTCGAAGCTCTTCAGTTATTTGACCGTGACTGGA
AAAAGATTGAAGCATTTGTTGGATCAAAGACAGTCATCCAGATACGTAGCCATGCTCAGAAATACT
TTCTAAAAGTTCAGAAGAGTGGGACAAATGAACATCTTCCTCCACCCAGACCAAAAAGAAAAGCTG
CTCATCCATATCCTCAGAAAGCTTCAAAAACTGCTCCAGTACTCTCACAAGTATCAGGATCCTTTC
AATCTTCATCAGCTTTGCTTGAACCTGGATACATATTAAAGCATGACTCTTCAGCAATGCCTAAAA
CTCCCATTATTAACACTGCAGTGTCTTCCTGGTCAAACAACTCTCTGCAGAAAACCACCAGCGTAT
TGCATGGGCAAAAACAAAAAGTGAATAATTGTTGCAGTAGCAGTAGAAGTCCTAGAGCGCAGTTGG
TTGGTGAATCTAATGGTCAAAGGAATAACAGCCATCCATTGAGAGTTCTTCC

SEQ ID NO: 130, ABH02896.1, MYB transcription factor MYB135 [Glycine max], partial sequence

NLDPSGMSLPGILPFAAAATATADSFEDPAKKTRKPYTITKSRESWTEPEHDKFLEALQLFDRDWK
KIEAFVGSKTVIQIRSHAQKYFLKVQKSGTNEHLPPPRPKRKAAHPYPQKASKTAPVLSQVSGSFQ
SSSALLEPGYILKHDSSAMPKTPIINTAVSSWSNNSLQKTTSVLHGQKQKVNNCCSSSRSPRAQLV
GESNGQRNNSHPLRVLP

SEQ ID NO: 131, AY826731.1, Pisum sativum Myb2 mRNA, partial cds
TTTACAAAGCAGNGAGANAGGTGGACAGATGAAGAACATAAGAAGTTCCTTGAAGCTTTAAAGCTG
TATGGCCGAGCCTGGCGAAAAATCGAAGAACATGTTGGCACAAAGACTGCTGTGCAGATTCGAAGT
CATGCTCAGAAGTTTTTTTCTAAGATCAATCGAGACACTAATGGGAACGATACGACATTGGTGGAG
TCAATTGA

SEQ ID NO: 132, AAX33631.1, Myb2 [Pisum sativum], partial sequence
FTKQXXRWTDEEHKKFLEALKLYGRAWRKIEEHVGTKTAVQIRSHAQKFFSKINRDTNGNDTTLVE
SI FIGURE 4 (continued)

SEQ ID NO: 133, DQ822916.1, Glycine max MYB transcription factor
MYB133 (MYB133) mRNA, complete cds
GGGACGAGCAAATCGAAAGACAAGAGTCACAGCGCACCCCCAAACAGAAACAGAGTTATTGGGAGC
ACGAAACACTAACTGACTCGATTCGATTGAGGTTACAAAACACTAAACTGATTCGATTCGATTCGA
TTGAGGTTTCGGTTTGGTCTTGATGGTGTCGGTGAACCCAAGCCCTGCTCAAGGCTTCTACTTCTT
CGATCCCTCCAACATGGTCCTTCCCGGCGTCAACAATCTTCCACCGCCCCGCCGCCTGCTCCGCC
TTCTCACGCCGCCGTGGAGGATCCGAGTAAGAAGATCAGGAAACCCTACACGATTACCAAGTCCAG
GGAGAGCTGGACTGAGCAGGAGCACGACAAGTTTCTAGAAGCTCTCCAATTATTTGATCGGGACTG
GAAAAAGATTGAAGCATTTGTTGGTTCAAAAACAGTTATCCAGATACGAAGTCATGCACAGAAGTA
TTTTCTTAAAGTTCAGAAGAAGGGAACAAGTGAACATGTACCTCCTCCCCGGCCAAAGAGAAAAGC
TGCTCGCCCATACCCTCAAAAAGCTCCTAAAACTCCTACTGTATCCCAAGTTATGGGCCCATTGCA
ATCTTCATCTTCTTTCATTGAACCTGCATACATTTATATCCCGGATTCTTCATCTGCGCTTGGAAC
TCCAGTTACTAACATGCCTTCGTCATCTTGGAACTATAATAATACACCACAATCTGTCAATGTGCC
ACAAGTGACCAGAGATGACATGGGATTCACTGTAGCTGGACAAACAGCTCCTCTTAATTGTTGCTG
CAGCAGTAGTAATGAGAGCACCCCTCCAACTTGGCCAAGTAGCAAAAGGACTAATCAAGGTGACCA
GGAGCCAATTAAAGTAATGCCAGATTTTGCACAAGTCTACAGCTTCATCGGCAGTGTATTCGATCC
AAATTCAACTAATCACCTACAGAAACTACGACAGATGGATCCATTAAATGTGGAAACGATATTGTT
GTTGATGAGAAATCTCTCCATCAATTTAATGAGTCCTGAATTTGAGGATCACAAGAGGCTGCTTTC
TTCATATGACACCGACTCTGACAAGTCGAAGTTGGTTAATATTTGCAGCAAATCCCTCACTAATAA
ATCTGAGAGTGCTGTTTTGTCTGCTTAGGATGTGGCCAGTGGTTTGCCCTCAATATATTTTCTGAA
TGCACATAAAGTGGGAGCAAGAAGGGGAGAAGACATAGGTTTTGCTAAAAGGAAGTGTAGTATCTA
GATGCTTGCAAGTTGAATGTGTATATAACTATATATAAATATATGTATACATTTTGGATTGAGTTT
TTGTTTGTTTTAGGCACTGTTAGATCGTAGATATGCTGGTGTGTTTGGTGTATATCTTTCGAAGAT
ATGATGATTGTCCTTGGAATGCAGGACAATGAGAGTCCTGTTAGGTCACTTCTGGAGGCTATACTG
TACAGTCTGTTGAGTGCTTTTGTTTATTATGCTGTGAAGCATAGGATTAGTATAAAAGAGTGGTGT
TAGGACTTAGGGGTGCCGCGTTGTATATATAAAGCAATAAAACAGTGCAGATAANTTTC SEQ ID NO: 134, ABH02857.1, MYB transcription factor MYB133
[Glycine max]
MVSVNPSPAQGFYFFDPSNMVLPGVNNLPPPPPPAPPSHAAVEDPSKKIRKPYTITKSRESWTEQE
HDKFLEALQLFDRDWKKIEAFVGSKTVIQIRSHAQKYFLKVQKKGTSEHVPPPRPKRKAARPYPQK
APKTPTVSQVMGPLQSSSSFIEPAYIYIPDSSSALGTPVTNMPSSSWNYNNTPQSVNVPQVTRDDM
GFTVAGQTAPLNCCCSSSNESTPPTWPSSKRTNQGDQEPIKVMPDFAQVYSFIGSVFDPNSTNHLQ
KLRQMDPLNVETILLLMRNLSINLMSPEFEDHKRLLSSYDTDSDKSKLVNICSKSLTNKSESAVLS
A SEQ ID NO: 135, DQ822984.1, Glycine max MYB transcription factor
MYB146 (MYB146) mRNA, partial cds
ACGAGGGACGAGCGAAACCCAAGACAAGAATCACAGCGCACAGTGACACATACATAAAAAAACGAA
ACACAAACAGAAACAGAGTTATTGGGAAACACGAAACACTAATTGATTCGAATTCGATTCGATTGA
GGATTGCTGTTTGGGTGTCTTGATGGTGTCGGTGAACCCAAACCCCGCTCAAGGCTTCTACTTCTT
CGATCCCTCCAACATGACCCTTCCCGGCGTCAACAATCTTCCACCGCCGCCGCCGCCGGCTCCGGC
TGCTCCCTCCGCCGTCGAGGATCCGAATAAGAAGATCCGGAAACCCTACACGATTACCAAGTCCAG
GGAGAGCTGGACCGAGCAGGAGCACGACAAGTTTCTAGAAGCTCTCCAATTATTTGATCGGGACTG
GAAAAAGATTGAAGCATTTGTTGGTTCAAAAACAGTTATCCAGATACGAAGTCATGCACAAAAGTA
TTTTCTTAAAGTTCAGAAGAATGGAACAAGTGAACATGTACCTCCTCCTCGGCCAAAGAGAAAAGC
TGCTCACCCATACCCTCAAAAAGCTCCTAAAACTCCTACTGTATCCCAAGTTATGGGCCCATTGCA FIGURE 4 (continued)

ATCTTCATCTGCTTTCATTGAACCTGCATACATTTATAGCCCAGATTCTTCATCTGTGCTTGGAAC
TCCAGTTACTAACATGCCTTTATCATCTTGGAATTATAATACTACACCACAACCAGGCAATGTGCC
ACAAGTGACCAGAGATGACATGGGATTGACTGGAGCTGGACAAGCTGCTCCTCTTAATTG

SEQ ID NO: 136, ABH02925.1| MYB transcription factor MYB146 [Glycine max]
MVSVNPNPAQGFYFFDPSNMTLPGVNNLPPPPPPAPAAPSAVEDPNKKIRKPYTITKSRESWTEQE
HDKFLEALQLFDRDWKKIEAFVGSKTVIQIRSHAQKYFLKVQKNGTSEHVPPPRPKRKAAHPYPQK
APKTPTVSQVMGPLQSSSAFIEPAYIYSPDSSSVLGTPVTNMPLSSWNYNTTPQPGNVPQVTRDDM
GLTGAGQAAPLN

SEQ ID NO: 137, DQ822940.1| Glycine max MYB transcription factor MYB155 (MYB155) mRNA, partial cds
ATGCACTAGAGAAGGGTGAGAAAGGGAAGGAAGAGCCTGAAACACCTGATGCTAACCAATTAGCCA
TTGACTTTAGTAATCGTCGTAGAAGTGTTAGCAATCTTACTGATTCTTGGAAAGAGGTCTCTGAAG
AGGGGAGACTGGCCTTTCAGGCTCTATTCTCCAGAGAGGTGTTGCCTCAAAGCTTTTCACCTCCTC
ATGCTTTGAAGAATAAGAATCAGCAAATGGACAACGCCAATAATAACAAGCAAAACATAGAAAATA
ACGAGGGACTGTTAACCATAGGGCTTGGACAAGGAAAGCTTAAGACTCGTCGAACAGGCTTTAAAC
CCTACAAAAGATGTTCCATGGAGGCCAAGGAAAATAGGGTTGGAGCGAGCAACAATCAAGGTGAAG
AGCAAGGTTGTAAGAGAATACGTNTGGAAGGGGAGACTTCGACTTGAGGTTTGATATATGCAGTAA
CATAAATGCAACCTTTGGGTTTTACATGTCATTTCTTAATCCCCCCACAACGGTGTAACTATATTG
NTTATTTCTAATTCTGCAGCTCACCGAAACTGTCGTGTAGATGTGGTGTCCATTTTGAA

SEQ ID NO: 138, ABH02881.1| MYB transcription factor MYB155 [Glycine max], partial sequence
ALEKGEKGKEEPETPDANQLAIDFSNRRRSVSNLTDSWKEVSEEGRLAFQALFSREVLPQSFSPPH
ALKNKNQQMDNANNNKQNIENNEGLLTIGLGQGKLKTRRTGFKPYKRCSMEAKENRVGASNNQGEE
QGCKRIRXEGETST

SEQ ID NO: 139, DQ822912.1| Glycine max MYB transcription factor MYB118 (MYB118) mRNA, complete cds
CTGCTTCCCACGCCACATCGTTCTCCCTCTCCCTCCCTCTCTCTCTCTCTCTCTCTCTCTCT
CTCTAAGCTCTTTCTTGTTGAAACTGTGAGTCTATGTTATTTGTGGCGGAGCATGAACTCCACCAC
CAACACTTCGAATTCTCAGTCAATGGCTGCAGCAGCACCGAGTGATGGTTCTGGGAAGAAGGTAAG
AAAGCCTTACACCATAACCAAGTCCAGAGAGAGTTGGACTGAGGAAGAACATGATAAGTTTCTCGA
AGCTCTCCAACTATTTGACAGGGACTGGAAGAAAATTGAAGATTTTGTAGGTTCAAAAACAGTTAT
TCAGATTCGAAGCCATGCCCAGAAATACTTCTTGAAAGTTCAAAAGAATGGGACTGTGGCACATGT
GCCTCCTCCCCGTCCAAAGCGCAAAGCTGCTCATCCTTACCCGCAAAAGGCATCAAAAAATGTTTT
GGTGCCACTACCAGCTTCCATTGGTTATGCTTCATCGAGAAATACGCTTGCACCTGGGTTTGCCTC
ATGGGATGAAACTTCCCTGCTGATGAATGCTGGAGCCGATAAACCCATGACCTGTCAGGATGAACT
CAACAATCTTCATCATGGAAATGAAGCTGATATTGGATCAAAGGGGATAGCACAGATTACCAACAG
CAGTCTCAGTGGTGTTGGAAATTCTACTAGAACACTACTGACTTCTGAGATACCAAAGCAAGGGAA
ACAAGCTCCAGTGCTTCATGGTTTGCCAGATTTTGCTGAAGTTTACGGTTTCATTGGAAGTGTATT
TGATCCAGAAACAAATGACCATGTCCAGAAGCTGAAGGAAATGGATCCTATAAATTTTGAAACTGT
TTTGTTGCTAATGAGAAACCTCACTGTCAACTTGTCTAGCCCTGACTTCGAACCCATTTGATAGAA
TGGGGAGACATCCCAATACTACTGGGCAAGGCGCCAATGACCCACCCAAAAGATTACTGCACAAGC
TTAAACCACAAGTAATTTGACAACTACTCAATTAGTACCTAGACGTCAAGGGATCTCTCTGAGAAG
GCCCCAGAGTGTTCTCTTTTTCTAATTACATGTGAATGACGTGATAGGATTTCCATGTAATAAATA
TAGGCTCTTGTATTAATTTGTGATTAGCCCCGGATTACTTGAAAAATTAAAGTATTTATTAGATA FIGURE 4 (continued)

SEQ ID NO: 140, ABH02853.1| MYB transcription factor MYB118 [Glycine max]
MNSTTNTSNSQSMAAAAPSDGSGKKVRKPYTITKSRESWTEEEHDKFLEALQLFDRDWKKIEDFVG
SKTVIQIRSHAQKYFLKVQKNGTVAHVPPPRPKRKAAHPYPQKASKNVLVPLPASIGYASSRNTLA
PGFASWDETSLLMNAGADKPMTCQDELNNLHHGNEADIGSKGIAQITNSSLSGVGNSTRTLLTSEI
PKQGKQAPVLHGLPDFAEVYGFIGSVFDPETNDHVQKLKEMDPINFETVLLLMRNLTVNLSSPDFE
PI

SEQ ID NO: 141, motif 1
W(T/S)(E/D/A/P/T/R)(G/E/P/Q/D/A/N/Y)E(H/Q)(D/E/N/R/K/Q/A/S)(K/R/L/
M/T/N/Q)F(L/I/V/M)(E/D/Q/I/L/V/M/T/A/R/H)(A/S/G)(L/I/M)(Q/H/I/K/R/
S/E/D/N)(L/M/K/R/Q/V/T)(F/Y/H/V/L/F)(D/G)(R/K/E)

SEQ ID NO: 142, motif 2
(F/H/Y/C/L)(V/I)(G/A/K/T/V/S/R)(S/T)(K/R)(T/N/S)(V/T/A/P/S)(I/V/T/
M/R/E/A)Q(I/V)(R/A/S)(S/M)(H/Y)(A/Y)(Q/D)(K/Y/N)(Y/H/F)(F/K/C)(L/T
/S/A/I/R/H)

SEQ ID NO: 143, motif 3
PP(P/Q)(R/Y/L)(P/H)(K/R/P)

SEQ ID NO: 144, motif 4

ATVAAA(S/T)AWWA

SEQ ID NO: 145, motif 5
DRSS(C/S)GSNT

SEQ ID NO: 146, rice GOS2 promoter sequence
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTCCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTTCGATCCATATCTTCCGGTCGAGTTCTTGG
TCGATCTCTTCCCTCCTCCACCTCCTCCTCACAGGGTATGTGCCCTTCGGTTGTTCTTGGATTTAT

FIGURE 4 (continued)

```
TGTTCTAGGTTGTGTAGTACGGGCGTTGATGTTAGGAAAGGGGATCTGTATCTGTGATGATTCCTG
TTCTTGGATTTGGGATAGAGGGGTTCTTGATGTTGCATGTTATCGGTTCGGTTTGATTAGTAGTAT
GGTTTTCAATCGTCTGGAGAGCTCTATGGAAATGAAATGGTTTAGGGTACGGAATCTTGCGATTTT
GTGAGTACCTTTTGTTTGAGGTAAAATCAGAGCACCGGTGATTTTGCTTGGTGTAATAAAAGTACG
GTTGTTTGGTCCTCGATTCTGGTAGTGATGCTTCTCGATTTGACGAAGCTATCCTTTGTTTATTCC
CTATTGAACAAAAATAATCCAACTTTGAAGACGGTCCCGTTGATGAGATTGAATGATTGATTCTTA
AGCCTGTCCAAAATTTCGCAGCTGGCTTGTTTAGATACAGTAGTCCCCATCACGAAATTCATGGAA
ACAGTTATAATCCTCAGGAACAGGGGATTCCCTGTTCTTCCGATTTGCTTTAGTCCCAGAATTTTT
TTTCCCAAATATCTTAAAAAGTCACTTTCTGGTTCAGTCAATGAATTGATTGCTACAAATAATGC
TTTTATAGCGTTATCCTAGCTGTAGTTCAGTTAATAGGTAATACCCCTATAGTTTAGTCAGGAGAA
GAACTTATCCGATTTCTGATCTCCATTTTAATTATATGAAATGAACTGTAGCATAAGCAGTATTC
ATTTGGATTATTTTTTTATTAGCTCTCACCCCTTCATTATTCTGAGCTGAAAGTCTGGCATGAAC
TGTCCTCAATTTTGTTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAATCGG
GATAGTTATACTGCTTGTTCTTATGATTCATTTCCTTTGTGCAGTTCTTGGTGTAGCTTGCCACTT
TCACCAGCAAAGTTC
```

SEQ ID NO: 147, prm07263
GGGGACAAGTTTGTACAAAAAAGCAGGCTTAAACAATGGAGACAAATTCGTCTGGA

SEQ ID NO: 148, prm07264
GGGGACCACTTTGTACAAGAAAGCTGGGTGAAAATAGAGTCTCATGTGGAAGC FIGURE 4 (continued)

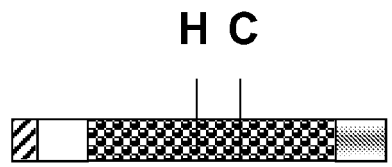

FIGURE 5 A

```
                      1                                                   50
P49042-castorbean  (1) METHK L FFTNYV FLVFT SF PIPGLLA RLNPFEPGILMP EEAE
SEQID2_VPEg        (1) ---MA T TRVSVG V FVL VS VAVSAAR GPDDVIKLPSQA RFFR
Consensus          (1)      S L    LL  L L       S              S   P 51                                                 100
P49042-castorbean (51) VQV DD  L  RWAVLVAGSM  GNYRHQAD CHAYQLLRKGG KEENII
SEQID2_VPEg       (48) AEN DDS SG RWAVLVAGSS WNYRHQAD CHAYQLLRKGG KEENII
Consensus         (51)     DDD N GTRWAVLVAGS GF NYRHQADICHAYQLLRKGGLKEENII
                            ▲

101                                                 150
P49042-castorbean (101) VFMYDDIAKNELN PGVIINH QSED YA VPKDYT  HVTAKNL AVI
SEQID2_VPEg       (98)  VFMYDDIANSYE   TIINS HGK MYQG VPKDYT  D NVD   AVI
Consensus        (101)  VFMYDDIA N  NPRPG IIN P G DVY GVPKDYTGD V   NLFAVI 151                                                 200
P49042-castorbean (151) LGDK AVQGGSGKVVDSKPNDRIE YSD GGPGVLGMPNLPYLYAMDFI
SEQID2_VPEg       (148) LGDK AVKGGSGKVVDSGPNDHIE YSD GGPGVLGMPTSPYLYANDLN
Consensus        (151)  LGDKSAV GGSGKVVDS PND IFIFYSDEGGPGVLGMP PYLYA D 201                                                 250
P49042-castorbean (201) DVLKKKHA GYKK VIY E  SGSIFEG  KD DIYVTTASN QESS
SEQID2_VPEg       (198) DVLKKKHA GTYKS  FY E  SGSIFEG  PEG NIYATTA N AE S
Consensus        (201)  DVLKKKHA G YK LV YLEACESGSIFEGILP  L IY TTASNA ESS 251                                                 300
P49042-castorbean (251) WGTYCPGMEPSPPPE  TTCLGDLYSVAWMEDSESHNLKKET KQQYSSVK
SEQID2_VPEg       (248) WGTYCPG EPSP PEF ETCLGDLYGVAWMEDSGMHNLQTET HQQYELVK
Consensus        (251)  WGTYCPG EPSPPPEF TCLGDLYSVAWMEDS HNL ETL QQY VK 301                                                 350
P49042-castorbean (301) A   NYNTY AG  V QYGNQSIKAD KLYL Q FD ASVN PPNN HLN-
SEQID2_VPEg       (298) R   PVG-  Y  SHVMQYGDVGISK NLDL MGIN ANDNFTFADANSLK
Consensus        (301)  RTA   YA GSHVMQYG   I DLLF G PA NF  A
```

FIGURE 5 B

```
                      1                                                50
SEQ ID NO: 172   (1)  ------------MVAARRSI  SVCL  ------SAWARPRLEP--A
SEQ ID NO: 170   (1)  ------MSS GHLL LVF YV  FY AD RKP-------------- Q
SEQ ID NO: 168   (1)  ------------MTPVA A V SLIAV A---------RQNPDDD I
SEQ ID NO: 166   (1)  ---------- PTFF PT L    AF TSV G---------RRDLVGDF
SEQ ID NO: 164   (1)  MAVDRSLTRCCSLV WSW  LR    QG  AR---------ANRKEWDSV
SEQ ID NO: 162   (1)  ---------- DRFP LF  AT  TLASG R---------------HD
SEQ ID NO: 160   (1)  ---------- AMASFRL P A    S---------VAHARTPRLEP--T
SEQ ID NO: 158   (1)  -------MMNSRVA AAWW CG   PLLA  AK---------GNSEP I
SEQ ID NO: 156   (1)  ---------- AMASFRP P A    A CL  LVLAVAHARTLRLEP--T
SEQ ID NO: 154   (1)  --------- APRWCFA L    CAA GAD SK---------GKWDP I
SEQ ID NO: 176   (1)  --------- AKSCYFRPA L    VLLVH ES---------RGRFEPK L
SEQ ID NO: 174   (1)  -------------- MTT  SF   A FLFLV A---------VSG---D I
SEQ ID NO: 178   (1)  -----MSSP GHFQ LVF  HA     F  AE RKT-------------- Q
SEQ ID NO: 150   (1)  ----MATTMIRVSVGVV F    SLAV  A---------RSG-PDD I
   Consensus    (1)              M   I  LLLLLLL A   SA                VIR 51                                               100
SEQ ID NO: 172  (31)   P Q-----RA--AAADET  GDV TRWAVL AGSNG  NYRPQAD CHA
SEQ ID NO: 170  (31)  DTG--------------SS  GAK TRWAVL AGS YY NYR QAD CHA
SEQ ID NO: 168  (30)   P QASRFFRP----NND  SSS G TRWAV  VAGS GY WNYR QA  CHA
SEQ ID NO: 166  (33)   P ET----------DN-  NFK TRWAV  AGSNG W NYR QA D CHA
SEQ ID NO: 164  (42)   KLP-------AEPVDADS  -HEV TRWAV  AGSNGYGNYR QA  CHA
SEQ ID NO: 162  (27)   P EASRFFKA----PANA  QNDE TRWAV  VAGSNG W NYR QA D CHA
SEQ ID NO: 160  (31)   P Q---------RAAGQE  DSV TRWAV  AGSNG  NYR QAD CHA
SEQ ID NO: 158  (34)  L  ENG-HAPAPAPGPAASAAEEEV TRWAVLVAGSS YENYRH A  CHA
SEQ ID NO: 156  (40)   P Q---------RAAGQE  DSV TRWAV  AGSNG  NYR QAD CHA
SEQ ID NO: 154  (32)  M GEEE---PATGDESSEKG DGV TRWAV  VAGSS GY NYR QA L CHA
SEQ ID NO: 176  (33)  M  --------EEANPADQ  DGV TRWAV  VAGSS GY NYR QA D CHA
SEQ ID NO: 174  (25)   P  ASKFFRP----TEND  S---T RWAV  AGS S   NYR QAD CHA
SEQ ID NO: 178  (32)  DN VE-----------SS  KSAK TRWAV  AGSNEY  NYR QA   CHA
SEQ ID NO: 150  (37)   P QASRFFRP----AEND  SNS G TRWAV  VAGSS GY NYR QA D CHA
   Consensus   (51)  LPS             D        GTRWAVLVAGSSGYWNYRHQADICHA 101                                              150
SEQ ID NO: 172  (74)  YQ I  KGG K EN IV FMYDD  AHS ENPR   VI INHPQGGDVYAGVPKD
SEQ ID NO: 170  (67)  YQ  RKGG K EN IV FMYDD AF EENP    VI INPDGGDVYEGVPKD
SEQ ID NO: 168  (76)  YQ  RKGG  EEN IV FMYDD AD EENPRK   INSPHGS VYEGVPKD
SEQ ID NO: 166  (71)  YQ  RKGG KEE NI V FMYDD AF GENP    VI INKPDGGDVYKGVPKD
SEQ ID NO: 164  (84)  Y   IKGG K EN IV FMYDD  AT ELNP    GI INHPEG DVYAGVPKD
SEQ ID NO: 162  (73)  YQ  RKGG  EEN IV FMYDD AF EENP    VI INSPHGN VYKGVPKD
SEQ ID NO: 160  (72)  YQ I  KGG K EN I V FMYDD AR  ENP    VI INHPQGDVYAGVPKD
SEQ ID NO: 158  (83)  YQ I RKGG K EN V FMYDD ANS  NPR A  INH KGK VYHGVPKD
SEQ ID NO: 156  (81)  Y   KGG  EN V FMYDD AH  ENP    VI INHPQGGDVYAGVPKD
SEQ ID NO: 154  (79)  YQ  RKGG VKEEN IV FMYDD ANN LNP   GVI INHPEGEDVYAGVPKD
SEQ ID NO: 176  (75)  YQ  RKGG KEEN IV LMYDD ANH LNP    GI INHPDS VYAGVPKD
SEQ ID NO: 174  (68)  YQ  RKGG VKEEN IV FMYDD AK EENPR   VI INSPNGEDVYNGVPKD
SEQ ID NO: 178  (70)  YQ IRKGG K EN I V FMYDD IAF SSENP    VI INKPDGEDVYKGVPKD
SEQ ID NO: 150  (83)  Y   RKGG  EEN IV FMYDD IAN YENPR GT  INSPHGKDVYQGVPKD
   Consensus  (101)  YQILRKGGLKEENIVVFMYDDIA NPENPRPGVIINHP G DVY GVPKD
```

FIGURE 6 B

```
                  151                                              200
SEQ ID NO: 172 (124) YTGREVNVDNFFAVLLGNKTAERGGSGKVVDSGPNDEIFVYYSDGGPGV
SEQ ID NO: 170 (117) YTKEAVNVRNFYNVLGNESGTTGGSGKVVKSGPNDSIFIYYADGGAPGV
SEQ ID NO: 168 (126) YTGDDVEVDNLFAVLGDKTAVKGGSGKVVDSGPNDEIFIYYSDEGGPGV
SEQ ID NO: 166 (121) YTGEDVTVDNFFAALLGNESALTGGSGKVVDLGPDDEIFVYYTDGGPGV
SEQ ID NO: 164 (134) YTGDMTIENLFAVVLGDKSKLVGGSGKVINSKPEDRIFIYYSTEGGPGI
SEQ ID NO: 162 (123) YVGEDVTVDNFFAALLGNKSALTGGSGKVVDSGPNDEIFIYYSDGGPCV
SEQ ID NO: 160 (122) YTGKEVNVRNFFAVLGNKTAVNGGSGKVVDSGPNLEIFVELSDGGPGV
SEQ ID NO: 158 (133) YTGDQVTAKNLYAVLGNKTAVTGGSRKVINSKPKDEIFIYYTDGGPGS
SEQ ID NO: 156 (131) YTGKEVNVKNFFAVLGNKTAVGGCSGKVVDSGPNDEIFVYYSDGGPGV
SEQ ID NO: 154 (129) YTGEAVTAKNFYAVLGNKTAVTGGSKRVIDCKPNDEIFIYYSDGGPGV
SEQ ID NO: 176 (125) YTGSSVTAANFYAVLGDQKAVKGGSGKVVASKPNDEIFVYYADGGPGV
SEQ ID NO: 174 (118) YTGDEVNVDNLLAVLGNKTAEGGSGKVVDGPNLEIFIYYSDGGGPCV
SEQ ID NO: 178 (120) YTKEAVNVQNFYNVLGNESGVTGNGKVVKSGPNDEIFIYYADGGAPGV
SEQ ID NO: 150 (133) YTGDDVNVDNLFAVLGDKTAVKGGSGKVVDSGPNDEIFIYYSDGGPGV
Consensus     (151) YTGDDVTVDNFFAVLLGNKTAVTGGSGKVVDSGPNDEIFIYYSDHGGPGV 201                                              250
SEQ ID NO: 172 (174) LGMPTYPYLYGDLIVDVLKKKHAASTYKSDVFYLEACESGSIFEGLLLEND
SEQ ID NO: 170 (167) LGMPDGEDIHAKDFSKVLEXMRKLRYKEMVIVYEACESGSMFEGLLKTN
SEQ ID NO: 168 (176) LGMPISEYIYADLINSVLKKKHSGTYKSMVFYLEACESGSIFEGLIEEG
SEQ ID NO: 166 (171) LGMPAGPYLYADLINVLKKKHASGTYKNLVFYLEACESGSIFEGLLRED
SEQ ID NO: 164 (184) LGMPNMPYIYAMDFLVLKKKHASGSYKEMVIYYEACESGSVFEGIMRKD
SEQ ID NO: 162 (173) LGMPINPYMYASLLLKVLKKKHASGTYKSLVFYLEACESGSIFEGLLEEG
SEQ ID NO: 160 (172) LGMPTYPYLYGDLIVDVLKKKHAGGTYKSLVFYLEACESGSIFEGLLEND
SEQ ID NO: 158 (183) LGMPNGPYVYAGDFFKRVLRQHASKSYSKMVIYYEACESGSIFEGLMEOD
SEQ ID NO: 156 (181) LGMPTYPYLYGDLIVDVLKKKHAASTYKSLVFYLEACESGSIFEGLLEND
SEQ ID NO: 154 (179) LGMPNLPYLYAADFKRVLQEHKANTYAKMVIYYEACESGSIFEGLMPAS
SEQ ID NO: 176 (175) LGMPNTPHIYAADFKRTLKKKHASGTYKEMVIYYEACESGSIFEGIMRKD
SEQ ID NO: 174 (168) LGMPISNIYANLINSVLKKKHSGTYKSLVFYLEACESGSIFEGLLPEG
SEQ ID NO: 178 (170) LAMPTGDEVMAKDFNEVLEXMKRKKYNKMVIYYEACESGSMFEGLLKKN
SEQ ID NO: 150 (183) LGMPTSPYLYANDLNSVLKKKHALGTYKSLVFYLEACESGSIFEGLLEEG
Consensus     (201) LGMPT PYLYA DLIDVLKKKHASGTYKSLVFYLEACESGSIFEGLLP D 251                                              300
SEQ ID NO: 172 (224) LNIYATTASNAEFSSWGTYCPG-EFPSPPEYETCLGDLYSVAWMEDSDF
SEQ ID NO: 170 (217) LNILAVTASNATESSEGIYCPGEYPSPPEYNGVCLGDTFSVSWEDSER
SEQ ID NO: 168 (226) LNIYATTASNAVESSWGTYCPG-EEPSPPEYETCLGDLYSVAWMEDSGV
SEQ ID NO: 166 (221) INIYATTASNAEESSWGTYCPG-EYPSPPEYTICLGDLYSVAWMEDSER
SEQ ID NO: 164 (234) KQIYVTTASNAQDNSWGTYCPG-MDSPPSEYIICLGDLYSVAWMEDSET
SEQ ID NO: 162 (223) LNIYATTASNAEESSWGTYCPG-EYPSPPGEYETCLGDLYSVAWMEDSDR
SEQ ID NO: 160 (222) KCVYATTASNAEESSWGAYCPG-EYPSPPEYDTCLGDLYSVAWMEDSDV
SEQ ID NO: 158 (233) HNIYVTAASNAVESSWAAYCPD-EGTPSPPEYFICLGDLYSVAWMEDSET
SEQ ID NO: 156 (231) KCVYATTASNAEESSWGTYCPG-EYPSPPEYETCLGDLYSVAWMEDSDV
SEQ ID NO: 154 (229) LNIYVTTASNAEESSWGTYCPG-MEPSPPSEYIICLGDLYSVAWMEDSET
SEQ ID NO: 176 (225) LNIYVTTASNAOESSCYGTYCPG-MNSPPSEYIICLGDLYSVAWMEDSET
SEQ ID NO: 174 (218) LNIYATTASNAEESSWGTYCPG-EDPSPS-EYETCLGDLYSVAWMEDSEK
SEQ ID NO: 178 (220) LNIYAVTAANSKESSWGVYCPESYPEPS-SEIGTCLGDTFSVSWEDSES
SEQ ID NO: 150 (233) LNIYATTASNAEESSWGTYCPG-EEPSPPEYETCLGDLYSVAWMEDSGM
Consensus     (251) LNIYATTASNAEESSWGTYCPG E PSPPPEYETCLGDLYSVAWMEDSDV
```

FIGURE 6 B (continued)

```
                    301                                               350
SEQ ID NO: 172 (273) ENLRTESLKQQYNEVKDRTAVQDIFSYGSHVMQYGSEENVKELRSYIGT
SEQ ID NO: 170 (267) EDMSKETLKQDYQAVKRRIGPDAEPGTSSHVSREGSKALLKDYIVSYIGT
SEQ ID NO: 168 (275) ENLQTETLRQQYELVRRPIAGGASA-YGSHVMSYIEVGLNKEKDSNMGI
SEQ ID NO: 166 (270) ENLRTETLKQQYKLVKERTISGDSY-YGSHVMQYGEVRESSEVEFHYIGT
SEQ ID NO: 164 (283) ENLKRESVKQQYKSVKQPTSNFNNYAMGSRVKQYGSINETAEKEYLYQGF
SEQ ID NO: 162 (272) ENLQTETLHQQYELVKQPIMNGNSI-YGSHVRQYGLIGLSENNIVRSYIGT
SEQ ID NO: 160 (271) ENLRTESLKQQYNEVKRRTAAQDSYSYGSHVMQYGSLDNAELLRSYIGT
SEQ ID NO: 158 (282) QMLKNETIKQQYEVKAPIAPRNESIRGSHVMFYGOKTFKEMGFLYQGF
SEQ ID NO: 156 (280) ENLRTESLKQQYDLVKKRTAAQDSYSYGSHVMQYGSEDNAQQFFLYIGS
SEQ ID NO: 154 (278) NNLKEETIKFQQYEVVKKRTSDMNSYSAGSHVMEYGQKTFKDRKELYQGF
SEQ ID NO: 176 (274) ENLKETIKQQYHTVKMPISNYNIYSGSRVREYGNNSIKSERELYQGF
SEQ ID NO: 174 (267) ENLQTETLHEQYELVKRRTAGSGKS-YGSHVMEFGGIGLSKERIVLFYGT
SEQ ID NO: 178 (269) EIMSKETLEQQYHMVFRRVGSDVP--ETSHVCRESTEKMLKEYISSYIGR
SEQ ID NO: 150 (282) ENLQTELHQQYELVKRPIAPVGYS-YGSHVMSYIEVGISKENEDSNMGI
      Consensus (301) HNLKTETLKQQYELVKKRTA   SY YGSHVMQYGDL L  D LFYIGT 351                                               400
SEQ ID NO: 172 (323) NPANDNFTIEDNSLPSFSKA-VNQRDADLVYEWQKYRKLAESSPENNE
SEQ ID NO: 170 (317) NPDNENFTFAGFTASPISTGSSVNTRGIPLLYLKSKIQRSIPMESPERQEL
SEQ ID NO: 168 (324) NPANENFTFVEANSITPPSGV-VNQRDADLVLIHWDFRYKAPEGSIRKTEA
SEQ ID NO: 166 (319) DPANENFTIVEENSLWSPSKP-VNQRDADLLLHWDFRKAPEGSLRKNTA
SEQ ID NO: 164 (333) DPAAVNFPPQ-NCRLEIKMEV-VNQRLAELFFMWQMKRSNHQPEKATDI
SEQ ID NO: 162 (321) NPANDNFTFVLKNSLVPPSKA-VNQRDADLIHSWDFRKAFVGSSRKAAA
SEQ ID NO: 160 (321) NPANENTIFVEDNALPSLSKA-VNQRDADLVYEWQKYRKLAESSPAKNN
SEQ ID NO: 158 (332) DPAKSSIRNR-PLPMPSLKGA-IKQRDADLLEMWKKYGKLNGSSEERQPA
SEQ ID NO: 156 (330) NPANNNTTFVEDNSLPSFSKA-VNQRDADLVYEWQKYRKLAESSPENNE
SEQ ID NO: 154 (328) NPANTNIIN---KLFLQAQKL-QSTKETQLFFSCGGGMSCYMKSRKRRT
SEQ ID NO: 176 (324) DPATVNLPLN-ELPVKSKIGV-VNQRDADLIFPLSHMKRIBEDSSRKSDT
SEQ ID NO: 174 (316) NPADENFTIVNENSIRPPSHV-TNQRDADLMFHWHFKQKAPEGSARKVEL
SEQ ID NO: 178 (317) NPENDNFTFTESFSSPISNSGLVNPRGIPLLYLQRKIQKAEMGSLESKEK
SEQ ID NO: 150 (331) NPANENFTFADANSIKPPSRV-TNQRDADLVITWEIYKIAPEGSAEKTEA
      Consensus (351) NPANDNFTFVE NSL S SR  VNQRDADLVHFW KYRKAPEGS RK EA 401                                               450
SEQ ID NO: 172 (372) RRELVKVMAHRSHVISSVELIGSLLEGSEDERVLKAVRAAGELVISS
SEQ ID NO: 170 (367) QKKLFEEMNHERQLLONIVELLKSLKQTNVLNSIISTRITGQPLVIEND
SEQ ID NO: 168 (373) QKQVLEAMSHRLHVINSVKLVGKLLEGISEGSEVINKVRPAGQRLAEDWT
SEQ ID NO: 166 (368) QKQVLEAMSHRMVENSVKLIGKLLEGIEKSEEVINAVRPAGSALVLIEWE
SEQ ID NO: 164 (381) LKQIAETVKHRKHILGSSVELIGVLLLGPGKSSSVLQSMRAPQLALVLWT
SEQ ID NO: 162 (370) EKQILEAMSHRMLILDSSMKLLFEGIEKQRELLSSVREPAGQPLVIEDWD
SEQ ID NO: 160 (370) RKQLLEMMGHRSHIDSSVELIGILLLEGSAGGSMVLKTVRPAGEPLVIEDWS
SEQ ID NO: 158 (380) LRENKETVLLITKHLLLLSIDFIGKLVIEGFDKGILVLEAARGSGQPLVIDWD
SEQ ID NO: 156 (379) RKQLLEMMGHRSHIDNSVELIINLLEGSADGPMVLKTIVRPAGEPLVIEMS
SEQ ID NO: 154 (374) F-----------------------------------------------
SEQ ID NO: 176 (372) LKEITETTRHKHIDASVELIAILLIGPTMN--VINLVRPQSLPLVIEDNE
SEQ ID NO: 174 (365) QKQVLEAMSHRLHVENSILLIGILLEGL-ESHAVLNKVRPSGEPLVIEND
SEQ ID NO: 178 (367) QKKLLEKNRRKQIEGSITDILRLSVKQTNVLNSIISTRITGQPLVIEDND
SEQ ID NO: 150 (380) QKQVLEAMSHRLHEINSVILVGKILLEGISRSEVLNKVRSAGQRLVIEEWN
      Consensus (401)   KQLLE M HR HIDNSV LIGKLLFG   GP VL SVR AG PLVDDW
```

FIGURE 6 B (continued)

```
                451                                                    500
SEQ ID NO: 172 (422) CLKSTVRTFEAQGGSLACYGMKHMRSFANICNAGILPEAVSKVAAQACTS
SEQ ID NO: 170 (417) GFKTSVNSFKNHGGATMLYGSKYTGALANICNMGVDVKQTVSKIEHACAH
SEQ ID NO: 168 (423) CLKNTVRAFERHCGSLSCYGIKHMRSFANICNAGIQMEQMEEAASQACTS
SEQ ID NO: 166 (418) CLKTMVRTFETHCGSLSQYGMKHMRSFANICNVGIKNEQMAEAAAQACVS
SEQ ID NO: 164 (431) CLKSMVRVFETHCGSLTCYGMKHMEAFANICNSGVSEASMEEATLAACEG
SEQ ID NO: 162 (420) CLKTVRTFETHCGSLSCYGIKHMRSFANFCNAGIRKEQMALASAQACVS
SEQ ID NO: 160 (420) CLKSTVRTFESQCGSLACYGMKHMRSFANICNAGIVPEAMAKVAAQACTS
SEQ ID NO: 158 (430) CLKTMVRVFESQGSSLTCYGMKHTRAFANICNNGVSEAEMKEASISACDG
SEQ ID NO: 156 (429) CLKSTVRTFESQCGSLACYGMKHMRSFANICNAGIVPEAMAKVAAQACTS
SEQ ID NO: 154 (375) --------------------------------------------------
SEQ ID NO: 176 (420) CLKSMVRVFEEHCGSLTCYGMKHMEAFANVCNNGVSKELMEEASTAACGG
SEQ ID NO: 174 (414) CLKSLVRAFERHCGSLSCYGIKHMRSIANKCNASIQMRQFFAAMQACPS
SEQ ID NO: 178 (417) GFKTSVNSFKNHGGATVEYGSKYTGALANICNMGVDVKQTVSKIEQASSM
SEQ ID NO: 150 (430) CLKNQVRAFERHCGSLSCYGIKHMRSFANICNASIQMEQMEEAASQACTS
     Consensus (451) CLKSLVRTFE HCGSLSQYGMKHMRSFANICNAGI  EQM EAAAQAC S
                501          517
SEQ ID NO: 172 (472) IPSN--SWSSLHKGFSA
SEQ ID NO: 170 (467) -----------------
SEQ ID NO: 168 (473) IPSG--PWCSLHRGFSA
SEQ ID NO: 166 (468) IPSN--SWSSLQRGFSA
SEQ ID NO: 164 (481) YNAG--LLHPSNRGYSA
SEQ ID NO: 162 (470) IPAS--SWSSLHRGFSA
SEQ ID NO: 160 (470) FPSN--SWSATHKGFSA
SEQ ID NO: 158 (480) YDMG--RWSPLVRGISA
SEQ ID NO: 156 (479) IPTN--SWSATHKGFSA
SEQ ID NO: 154 (375) -----------------
SEQ ID NO: 176 (470) YSEARYTVHPSILGYSA
SEQ ID NO: 174 (464) IPTS--SWSSLDRGFSA
SEQ ID NO: 178 (467) -----------------
SEQ ID NO: 150 (480) IPSG--SWCSLNRGFSA
     Consensus (501) IPT    PWSSL RGFSA
```

FIGURE 6 B (continued)

SEQ ID NO: 159, DNA - Arabidopsis thaliana
ATGGCCACAACGATGACACGTGTCTCCGTCGGCGTCGTCCTCTTTGTTCTCTTAGTCTCGCTGGTT
GCCGTCTCCGCCGCGAGAAGCGGTCCTGATGATGTTATCAAACTCCCTTCGCAGGCTTCTCGCTTC
TTCCGTCCTGCTGAAAACGACGACGATTCTAACTCCGGTACTAGGTGGGCTGTTCTAGTCGCCGGA
TCTAGCGGATATTGGAATTACAGGCATCAGGCTGATATATGCCATGCCTATCAACTTCTGAGGAAA
GGTGGATTGAAAGAGGAGAATATTGTGGTATTCATGTATGATGATATTGCTAACAATTACGAGAAT
CCAAGGCCTGGAACCATTATCAACAGCCCTCATGGAAAAGATGTCTATCAAGGAGTTCCCAAGGAT
TATACTGGAGATGATGTCAATGTTGATAATCTATTTGCTGTGATCCTTGGAGACAAAACTGCTGTT
AAAGGGGGAAGTGGGAAGGTTGTGGATAGTGGTCCTAATGATCATATCTTCATATTCTACAGTGAC
CATGGTGGTCCTGGAGTTCTTGGGATGCCAACTTCTCCTTACCTATATGCAAATGATCTCAATGAT
GTCTTGAAGAAGAAACATGCTTTAGGAACATATAAAAGCTTGGTGTTTTATCTCGAAGCTTGCGAA
TCTGGAAGTATCTTTGAAGGGCTTCTTCCTGAGGGTTTGAACATCTATGCCACAACTGCATCAAAC
GCCGAAGAAAGCAGTTGGGGTACCTATTGCCCTGGAGAGGAACCCAGTCCTCCACCGGAGTATGAA
ACTTGTTTAGGTGACTTGTACAGTGTTGCTTGGATGGAAGATAGTGGTATGCACAATTTACAGACT
GAGACTCTGCACCAGCAATATGAACTTGTGAAAAGGAGGACTGCACCTGTTGGGTACTCTTATGGT
TCTCATGTCATGCAATATGGCGATGTAGGAATTAGCAAGGATAATCTCGATCTTTATATGGGAACA
AACCCTGCCAATGACAATTTTACCTTTGCGGATGCGAATTCACTAAAGCCACCTTCAAGAGTTACA
AACCAGCGTGATGCAGATCTTGTTCATTTTTGGGAAAAGTACCGAAAAGCACCAGAAGGTTCAGCA
AGAAAAACAGAAGCTCAGAAGCAAGTACTTGAAGCCATGTCTCACAGACTTCATATTGACAATAGC
GTGATACTCGTCGGAAAAATCTTGTTTGGCATTTCGAGAGGTCCTGAAGTGCTAAACAAAGTACGG
TCTGCTGGGCAACCTCTAGTCGATGACTGGAACTGCCTTAAAAATCAGGTGAGAGCTTTCGAGAGG
CACTGTGGATCGCTGTCTCAGTACGGTATCAAGCACATGAGGTCTTTTGCAAACATCTGCAATGCA
GGGATTCAAATGGAGCAAATGGAGGAGGCAGCTTCACAGGCTTGTACCACACTGCCAACTGGTCCT
TGGAGCTCGCTTAACCGTGGATTCAGTGCATAGAAACCCTAAAC

SEQ ID NO: 150, PRT - Arabidopsis thaliana
MATTMTRVSVGVVLFVLLVSLVAVSAARSGPDDVIKLPSQASRFFRPAENDDDSNSGTRWAVLVAG
SSGYWNYRHQADICHAYQLLRKGGLKEENIVVFMYDDIANNYENPRPGTIINSPHGKDVYQGVPKD
YTGDDVNVDNLFAVILGDKTAVKGGSGKVVDSGPNDHIFIFYSDHGGPGVLGMPTSPYLYANDLND
VLKKKHALGTYKSLVFYLEACESGSIFEGLLPEGLNIYATTASNAEESSWGTYCPGEEPSPPPEYE
TCLGDLYSVAWMEDSGMHNLQTETLHQQYELVKRRTAPVGYSYGSHVMQYGDVGISKDNLDLYMGT
NPANDNFTFADANSLKPPSRVTNQRDADLVHFWEKYRKAPEGSARKTEAQKQVLEAMSHRLHIDNS
VILVGKILFGISRGPEVLNKVRSAGQPLVDDWNCLKNQVRAFERHCGSLSQYGIKHMRSFANICNA
GIQMEQMEEAASQACTTLPTGPWSSLNRGFSA

SEQ ID NO: 151, DNA - Triticum aestivum
GGCGGCAGAGCAGNCTGACTGAAGCAGAGAGCAGCAGTTCACCATGGCTCGCCTTTCCTGCTCACC
CCTCCTCCTCCTCTTCTTGTCGTCGCAGCTCGCCCTGCTCGTCGCCGGCGAGTTCCTCCGCCT
GCCGTCCGAGAAGGACGTCGTCGGGACGAGATGGGCCGTCCTCATCGCCGGCTCCAACGGCTACTA
CAACTACCGCCACCAGGCGGACGTATGCCACGCGTACCAGATCATGAAGAAGGGCGGGCTGAAGGA
CGAGAACATCATCGTCTTCATGTACGACGACATCGCCGGCAACCGCGACAACCCCAGGCCTGGGGT
CATCATCAACCACCCCAAAGGCGGCGACGTCTACGCCGGAGTCCCCAAGGACTACACGGGGCAGA
CGTCAACGCCAACAACTTCCTCGCCGCGCTGCTCGGCGACAAGTCCAAGCTCACCGGCAGCGGCAG
CGGCAAGGTCGTCAGCAGCGGCCCGGACGACCACATCTTCGTCTATTACGCCGATCACGGTGGCCC
AGGGATCCTTGGGATGCCGGCGACGAGGAGTACCTGTACGCGAACGACCTGGTGCGGACGCTGGA
GAAGAAGCACGCCGGCGGGCCGGGTATAAGAGCCTGGTCTTCTACCTGGAGGGCCTGCGAGTCCG
GGAGCATCTTCGAGGGCCTCCTCCCGGGCAACATCAGCGTGTACGCCACCACGGCGGCCAACGCGG

FIGURE 8

```
AGGAGAGCAGCTGGGGCACCTACTGCCCCGGCGACGACGAGGGCGCCCCGCCGCCGGAGTACGACA
CCTGCCTCGGCGACCTCTACAGCGTCGCCTGGATGGAGGACAGCGACGCGCACAACCTCAACGCCG
AGTCCCTTAAGCTGCAGTACGAGCGGGTCAGGGACCGGACGTCGGCGGGCGGCACGTACAGCCTCG
GCTCCCACGTCATGCAGTACGGCGACCTGGGCCTCAACGACCAGAGCCTCTTCGTCTACATCGGCA
CCAACCCTGCCAACGACAACGCCTCCTTCGTCCAGGGCTCCTCCTCGACCTCCAGGCAGCTGCCGG
GCGGCGGAGTGAACCAGCGGGACGCCGACCTCGTCCACTTCTGGCACAAGTACCGGAGTCGGCGGA
GGGGTCGGCCGAGAAAGGCGAGGCGCGGAGGCGGCTGGTGGAGACGATGGCGCGGCGGTCTCGCGT
GGACAGCAGCGTGGAGCTCATCGGCGGCCTCCTCTTCGGCTCAGAGGAAGGTGCCAAGGTCCTCGG
CGCCGTGCGGCCGGCGGGGCAGCCTGTGGTGGATGACTGGGACTGCCTCAAGTCTGTGGTGCGGAC
GTTCCAGCAGCGGTGCGGGCCGCTGACGCAGTACGGGATGAAGCACATGCGCTCGCTCGCCAACCT
CTGCAACGCCGGCGTCCGGGAGGAGGCCATGGACAAGGCTGCGGCTCAGGCGTGCGCTGCTAATCC
TTCCTCCTTGTTCTGATCAAACTGTGTGATCGATCCATGTCGCATCGGTCACCTAAAATATGGTGT
GATGGATCGATCTATACGGTCGTGATTGCTGTAAATACTAATACATGCTGCACAGCAAGTACGTGA
TTGCTGTAAATACTATGTGCTATTATTTGCTATACAAAGAAAATAGCTCTCTC
```

SEQ ID NO: 152, PRT - Triticum aestivum
```
MARLSCSPLLLLLFLSSQLALLVAGEFLRLPSEKDVVGTRWAVLIAGSNGYYNYRHQADVCHAYQI
MKKGGLKDENIIVFMYDDIAGNRDNPRPGVIINHPKGGDVYAGVPKDYTGADVNANNFLAALLGDK
SKLTGSGSGKVVSSGPDDHIFVYYADHGGPGILGMPGDEEYLYANDLVRTLEKKHAGGAGYKSLVF
YLEGLRVREHLRGPPPGQHQRVRHHGGQRGGEQLGHLLPRRRGRPAAGVRHLPRRPLQRRLDGGQ
RRAQPQRRVPXAAVRAGQGPDVGGRHVQPRLPRHAVRRPGPQRPEPLRLHRHQPCQRQRLLRPGLL
LDLQAAAGRRSEPAGRRPRPLLAQVPESAEGSAEKGEARRRLVETMARRSRVDSSVELIGGLLFGS
EEGAKVLGAVRPAGQPVVDDWDCLKSVVRTFQQRCGPLTQYGMKHMRSLANLCNAGVREEAMDKAA
AQACAANPSSLF
```

SEQ ID NO: 153, DNA - Triticum aestivum
```
GGCGCCTACTTTACCCCGCACCCCGCGCCGCTCTTCTCGCCCGTACGTTCCGGCTCCCCGCGCGG
TGCTCTTAGACAGTAGTGCTACTGCGACCTCACCTGCGCAGACGGATGGCGCCGCGGTGGTGCTTC
GCGTTGCTCCTGCTGCTGTGTGCGGCGGCCGGGGCTGACGCCTCGAAGGGGAAGTGGGACCCGGTG
ATCCGGATGCCGGGGAGGAGGAGCCCGCCACGGGCGACGAGAGCTCCGAGAAGGGGGAGGACGGC
GTCGGGACGAGGTGGGCGGTGCTCGTCGCCGGATCCTCCGGCTACGGAAACTACAGGCACCAGGCC
GATATATGCCATGCCTACCAGATATTGAGAAAGGGGGCGTAAAAGAGGAGAACATCGTGGTTTTT
ATGTATGATGACATTGCCAACAACCCTCTCAACCCGAGGCCAGGGGTTATCATCAACCACCCAGAG
GGCGAAGATGTATATGCTGGCGTTCCAAAGGACTACACCGGAGAGGCAGTTACTGCTAAGAACTTC
TATGCAGTTCTCTTGGGCAACAAAACTGCGGTCACTGGAGGGAGTAAGAAGGTCATAGATAGCAAA
CCAAATGACCATATATTTATCTACTACTCAGATCACGGGGGTCCCGGAGTCCTTGGTATGCCCAAC
CTGCCATATCTCTATGCTGCTGATTTATCAAGGTCTTACAAGAAAACATGCATCCAATACCTAT
GCAAAAATGGTTATATATGTGGAAGCTTGTGAAAGTGGCAGTATTTTGAGGGTTTGATGCCTGCA
GACCTCAATATTTATGTCACAACAGCATCTAATGCAGAAGAAAGCAGCTGGGGTACATACTGCCCA
GGAATGGAACCATCGCCTCCTTCTGAGTATATTACCTGCTTAGGTGATCTCTACAGTATTTCTTGG
ATGGAAGACAGTGAGACTAATAATCTGAAGGAGGAGACAATCAAGAAGCAGTATGAAGTGGTAAAG
AAGCGAACCTCAGACATGAACAGCTATAGTGCCGGTTCTCATGTTATGGAGTATGGCGACAAGACC
TTCAAGGATGAGAAGCTTTACCTTTATCAAGGTTTCAATCCTGCAAACACCAACATTACAAACAAG
CTATTTTTGCAAGCCCAAAGGCTGCAATCAACCAAAGAGACGCAGATCTTCTTTTCTTGTGGAGGA
GGTATGAGCTGCTACATGAAAAGTCGAAAGAGAAGACGAACGTTCTGAGGGAGATCAGTGAGACAG
TCACCCACAGGAAGCATCTTGACAGCAGCATCGATTTATTGGAAGCTTCTATTTGGCTTCGAGA
ATGGACCTTCGGTGCTTCAAGCTGTCAGACCTCTGGGAAGCCTCTAGTGGACGACTGGGATTGCC
```

FIGURE 8 (continued)

```
TGAAGAGGATGGTGCGGATCTTTGAGTCTCATTGCGGATCGCTCACTCAGTACGGTATGAAGCACA
TGCGAGCATTTGCAAATATATGCAACAATGGTGTTTCTGGCACGACGATGAAGGAAGCAAGCATCA
ATACCTGCGGCGGTCACAACTCGGCAAGATTGAGCACCTTGATCCAAGGGTACAGCGCTTGATCGA
TCAGTCTGCTGAGGTACATACTAGTATGTTCCTTGTCCTCAGCTTACGCAATGTGAATATGTAGT
ATTGTATTGTATTGTACTGTTAGTGTATCCTGAAAATAACCTTGGGGCCGGCTATATAAGAATGTG
CCTATGT
```

SEQ ID NO: 154, PRT - Triticum aestivum
```
maprwcfallllcaaagadaskgkwdpvirmpgeeepatgdessekgedgvgtrwavlvagssgy
gnyrhqadichayqilrkggvkeenivvfmyddiannplnprpgviinhpegedvyagvpkdytge
avtaknfyavllgnktavtggskkvidskpndhifiyysdhggpgvlgmpnlpylyaadfikvlqe
khasntyakmviyveacesgsifeglmpadlniyvttasnaeesswgtycpgmepsppseyitclg
dlysiswmedsetnnlkeetikkqyevvkkrtsdmnsysagshvmeygdktfkdeklylyqgfnpa
ntnitnklflqaqrlqstketqiffscgggmscymksrkrrrtf
```

SEQ ID NO: 155, DNA - Triticum aestivum
```
ACGCGTCCGTTAAACCCCTCCTTCCTCCTCCCCCTCGCTTCTTCGCGGAATCCAAACCCCAAACAC
CAGCCATGGCGATGGCGTCCTTCCGCCCCCTTCCCCTCGCTCTCCTGCTCGCCGCGTGCCTCTCGG
CGCTCGTGCTGGCCGTGGCGCACGCGCGGACCCTACGGCTGGAGCCCACCATCCGGCTGCCGTCGC
AGCGCGCCGCCGGGCAGGAGGACGATGACTCCGTCGGGACCAGGTGGGCCGTCCTCATCGCCGGCT
CCAACGGCTACTACAACTACCGCCACCAGGCGGATATCTGCCACGCCTACCAGATCATGAAGAAGG
GTGGTCTCAAGGATGAGAACATCATCGTATTCATGTACGACGACATTGCGCACAACCCGGAGAACC
CGAGGCCGGGCGTCATCATCAACCACCCCAGGGTGGAGATGTCTATGCTGGGGTCCCTAAGGACT
ACACTGGAAAGGAGGTTAATGTCAAGAACTTCTTTGCTGTCCTGCTCGGTAATAAAACCGCTGTGA
GTGGTGGGAGCGGCAAAGTCGTGGACAGTGGCCCTAATGATCACATTTTTGTGTTTTACAGTGACC
ATGGGGGTCCTGGGGTCCTTGGGATGCCTACCTATCCATACCTTTACGGTGACGATCTTGTAGATG
TCCTGAAGAAAAAGCACGCTGCTGGAACCTACAAAAGCCTGGTATTTTACCTTGAAGCCTGCGAAT
CTGGGAGCATCTTTGAGGGACTTCTGCCGAATGACATCGGTGTCTATGCGACCACCGCATCGAACG
CAGAGGAAAGCAGTTGGGGAACGTATTGCCCCGGCGAGTACCCCAGCCCTCCGCCGGAATATGACA
CTTGCTTGGGCGACCTGTACAGCATTTCTTGGATGGAAGACAGTGATGTCCACAACCTGAGAACTG
AATCTCTCAAGCAGCAATATGACTTGGTCAAGAAGAGAACAGCAGCTCAGGACTCATACAGCTATG
GTTCCCATGTGATGCAATACGGTTCTTTGGACCTGAATGCTCAACAATTCTTTTTGTACATCGGCT
CAAATCCTGCTAACAATAACACTACATTTGTTGAAGATAACTCACTGCCGTCCTTCTCAAGAGCTG
TTAATCAGAGGGATGCTGATCTTGTTTACTTCTGGCAGAAGTACCGGAAATTGGCTGAGAGCTCCC
CTGAGAAAAACGATGCTCGGAAGCAATTGCTTGAAATGATGGGTCATAGATCTCATATTGACAACA
GCGTCGAGCTGATTGGAAACCTTCTGTTTGGTTCTGCGGATGGTCCGATGGTTCTAAAGACTGTTC
GCCCAGCTGGTGAGCCTCTTGTTGATGACTGGAGTTGTCTCAAGTCTACGGTGCGTACTTTTGAAT
CACAATGTGGCTCGCTGGCGCAGTATGGAATGAAGCACATGCGGTCCTTTGCAAACATCTGCAATG
CCGGCATTGTTCCTGAAGCGATGGCAAAGGTTGCTGCTCAGGCGTGCACGAGCATCCCAACCAACC
CCTGGAGTGCCACACACAAGGGTTTTAGTGCTTAAACCAGAGGTGAAGCAACTTGGTCCCTATCTC
AGCTATTGTACCATATACCAAAGTCCCTTCCTATTCACACAGGGTTAGTAGTGCTTGAACCAACGA
ACCTTAGATGAATAAGAATTATGCCATTATTTCAGCTATTCCACCACACCAAATTACCTTGGCTGT
GTCCAACTTATAATGTACATATACCCGTAGTAGAAAGGTGATTTCCTGTGATTGCTGTACATACTC
GTGATAGTTCGTGATCAGATGTGTAGCTCTCAATTCCATATACGAATGCAATCACTGCTATTTGT
```

SEQ ID NO: 156, PRT - Triticum aestivum
```
MAMASFRPLPLALLLAACLSALVLAVAHARTLRLEPTIRLPSQRAAGQEDDDSVGTRWAVLIAGSN
GYYNYRHQADICHAYQIMKKGGLKDENIIVFMYDDIAHNPENRPGVIINHPQGGDVYAGVPKDYT
```

FIGURE 8 (continued)

GKEVNVKNFFAVLLGNKTAVSGGSGKVVDSGPNDHIFVFYSDHGGPGVLGMPTYPYLYGDDLVDVL
KKKHAAGTYKSLVFYLEACESGSIFEGLLPNDIGVYATTASNAEESSWGTYCPGEYPSPPPEYDTC
LGDLYSISWMEDSDVHNLRTESLKQQYDLVKKRTAAQDSYSYGSHVMQYGSLDLNAQQFFLYIGSN
PANNNTTFVEDNSLPSFSRAVNQRDADLVYFWQKYRKLAESSPEKNDARKQLLEMMGHRSHIDNSV
ELIGNLLFGSADGPMVLKTVRPAGEPLVDDWSCLKSTVRTFESQCGSLAQYGMKHMRSFANICNAG
IVPEAMAKVAAQACTSIPTNPWSATHKGFSA

SEQ ID NO: 157, DNA - Triticum aestivum
CTACGAATATGAGGCGCTGCGCCTGCCGTCCGCGGAGCAGAACTGCCAGGCGATCGACGATCACAC
TTTACCTCCTGCGCGCACTGCACGCCGACGCGAGTATAAAATGCGGGCCCAGCCCCCGCCGGAACG
ATCACACTTCACTCTCTGCCTTCTCTTCCTTTCTAGGCTCTAGCACACGCACATGATGAACTCGAG
GGTGGCGATGGCTGCGTGGTGGGTTTGTGGACTCCTCCCGCTCCTGGCGGAGGCGGCCAAGGGGAA
CTCGGAGCCGCTGATCCGGCTGCCGACGGAGAATGGGCATGCCCCTGCCCCTGCGCCTGGCCCTGC
CGCGTCGGCGGCGGAGGAAGAGGTGACGAAGTGGGCCGTGCTCGTTGCCGGCTCCTCCGGCTACGA
GAACTACCGGCACCAGGCCGATGTGTGCCACGCGTACCAGATCCTGAAGAAGGGGGGACTCAAGGA
TGAGAACATTGTGGTGTTTATGTACGATGACATCGCCAACAGCCCTGACAACCCAAGGCGTGGAGC
CGTCATCAACCATCCTAAAGGCAAAGATGTTTACCATGGTGTTCCCAAGGACTACACCGGTGACCA
GGTCACTGCTAAGAACTTGTATGCGGTTCTCCTGGGGAACAAAACCGCGGTTACCGGAGGGAGTAG
GAAGGTGATAAACAGCAAACCGAAGGATCACATCTTCATCTACTACACGGATCATGGGGGTCCTGG
TTCACTTGGTATGCCCAACGGGCCATATGTTTATGCTGGCGACTTCATCAAAGTGTTACGGCAAAA
GCATGCTTCCAAAAGCTATTCGAAAATGGTCATATATGTTGAAGCGTGTGAAAGTGGCAGCATCTT
TGAGGGTTTGATGCCACAAGATCACAATATTTATGTTACAGCGGCATCAAATGCGGTAGAAAGTAG
CTGGGCAGCATACTGCCCTGATGATGGAACGCCACCTCCTCCTGAATATTTTACCTGTTTAGGTGA
CTTATACAGTGTTTCTTGGATGGAAGACAGTGAAACTCAAAATCTAAAGAACGAAACCATCAAGCA
GCAGTACGAGGTGGTTAAAGCGAGAACGGCACCCCGAAATGAGTCCATTAGAGGTTCTCATGTCAT
GGAGTATGGCGACAAGACTTTCAAGGAGGACATGCTTTTCCTCTACCAAGGTTTCGATCCGGCGAA
GTCAAGCATCAGAAACAGGCCGCTGCCTATGCCCAGCCTCAAGGGTGCAATCAAGCAAAGAGATGC
CGATATTCTCTTCATGTGGAAGAAGTATGGAAGTTGAATGGGGGATCAGAAGAGAAGCAGAGGGC
CCTCAGGGAGGTCAAAGAAACCGTGCTGCACAGGAAGCATCTGGACAGCAGTATCGATTTCATCGG
GAAGCTTGTCTTTGGGTTCGACAAGGGGCCTTTGGTGCTCGAGGCTGCTAGAGGCTCTGGCCAGCC
ATTGGTCGACGATTGGGATTGTCTGAAGACGATGGTGCGAGTGTTCGAGTCCCAGTGCGGATCACT
CACTCAGTACGGCATGAAACACACGAGGGCGTTCGCAAACATGTGCAACAATGGCGTCTCCGAGGC
CGAGATGAAGGAGGCGAGCATCAGCGCTTGCGACGGCTACGACATGGGGAGGTGGAGCCCGTTGGT
TCGAGGCTACAGCGCCTGATCCGCTTGCAGTGCAGTACTACTACATGGCAGCAGCAGCAGCCAGAG
CTCCGGAGTTCCTAGCTAGACCTCGTATGGTGTACATACACATTGGTATACCGTATACATACAA
GAAAGAAG

SEQ ID NO: 158, PRT - Triticum aestivum
MMNSRVAMAAWWVCGLLPLLAEAAKGNSEPLIRLPTENGHAPAPAPGPAASAAEEEVTKWAVLVAG
SSGYENYRHQADVCHAYQILKKGGLKDENIVVFMYDDIANSPDNPRRGAVINHPKGKDVYHGVPKD
YTGDQVTAKNLYAVLLGNKTAVTGGSRKVINSKPKDHIFIYYTDHGGPGSLGMPNGPYVYAGDFIK
VLRQKHASKSYSKMVIYVEACESGSIFEGLMPQDHNIYVTAASNAVESSWAAYCPDDGTPPPPEYF
TCLGDLYSVSWMEDSETQNLKNETIKQQYEVVKARTAPRNESIRGSHVMEYGDKTFKEDMLFLYQG
FDPAKSSIRNRPLPMPSLKGAIKQRDADILFMWKKYGKLNGGSEEKQRALREVKETVLHRKHLDSS
IDFIGKLVFGFDKGPLVLEAARGSGQPLVDDWDCLKTMVRVFESQCGSLTQYGMKHTRAFANMCNN
GVSEAEMKEASISACDGYDMGRWSPLVRGYSA

FIGURE 8 (continued)

SEQ ID NO: 159, DNA - Hordeum vulgare
GAATTAAACCCCTTCCTCCTCCCAATTCGCGTCTTCACGGAATCCAAACCCCAAACACCATCCATG
GCGATGGCGTCCTTCCGCCTCCTTCCTCTCGCGCTCCTGCTCTCCGTGGCGCACGCGCGGACCCCA
CGGCTTGAGCCCACCATCCGGCTGCCGTCGCAGCGCGCCGCCGGGCAGGAGGACGATGACTCCGTC
GGGACCAGGTGGGCCGTCCTCATCGCCGGCTCCAACGGCTACTACAACTACCGCCACCAGGCCGAT
ATCTGCCACGCCTACCAGATCATGAAGAAGGGTGGTCTCAAGGATGAAAACATCATCGTTTTCATG
TACGACGACATTGCGCGCAACCCAGAGAACCCAAGGCCGGGCGTCATCATCAACCACCCCCAGGGT
GGAGATGTCTATGCTGGGGTCCCTAAGGACTACACTGGGAAGGAGGTTAATGTCAAGAACTTCTTT
GCTGTCCTGCTCGGTAATAAAACTGCTGTGAATGGTGGGAGCGGCAAAGTCGTGGACAGTGGCCCT
AATGATCACATTTTTGTGTTTTACAGTGACCATGGGGGTCCTGGGGTCCTTGGGATGCCTACCTAC
CCATACCTTTATGGTGACGATCTTGTAGATGTCCTGAAGAAAAAGCATGCTGCTGGAACCTACAAA
AGCCTGGTCTTTTACCTTGAAGCCTGTGAATCTGGGAGCATCTTTGAGGGGCTTCTGCCGAATGAT
ATCGGTGTCTACGCGACCACCGCATCAAACGCAGAGGAGAGCAGTTGGGGAGCGTATTGCCCTGGC
GAGTACCCGAGCCCTCCGCCGGAATATGACACTTGCTTGGGCGACCTATACAGCATTTCTTGGATG
GAAGACAGTGATGTCCACAACCTGAGGACTGAATCTCTCAAGCAGCAGTATAACCTGGTCAAGAAG
AGAACGGCAGCTCAGGACTCATACAGCTATGGTTCCCATGTGATGCAATACGGTTCTTTGGACCTC
AATGCTGAACATTTGTTCTCGTACATTGGGTCAAATCCTGCTAACGAGAACACTACATTTGTTGAA
GATAATGCATTGCCGTCGTTATCAAGAGCTGTTAATCAGAGGGATGCTGATCTTGTTTATTTCTGG
CAGAAGTACCGGAAATTGGCTGAGAGCTCCCCTGCGAAAAACAATGCTCGTAAGCAATTGCTCGAA
ATGATGGGTCATAGATCTCATATTGACAGCAGCGTTGAGCTGATTGGAAACCTTCTGTTTGGTTCT
GCGGGTGGTCCAATGGTTCTAAAGACTGTTCGCCCAGCTGGTGAGCCTCTTGTGGATGACTGGAGT
TGTCTCAAGTCTACGGTGCGTACTTTTGAATCCCAATGTGGCTCGTTGGCGCAGTATGGAATGAAG
CACATGCGGTCCTTTGCAAACATGTGTAATGCCGGCATTGTTCCTGAAGCGATGGCAAAGGTTGCT
GCTCAGGCGTGCACGAGCTTCCCAACCAACCCGTGGAGTGCCACACACAAGGGTTTTAGTGCTTAA
ACCAGAGGTGAAGAAGCAACGTAATCACTATCTCAGCTATTGTACCATATACCAAAGTCCCTTCCT
ATTCACACAGGGTTAGTAGTGCTTGAACGAGCCTTAGGTGAATAAGAATTATGCTATTATTTCGGC
TATTCCATCATACTCCCTCTGTTCCTAAATACTTGTTGTTGGGGAGAACTCTCCCCGGCAACAAAT
ATTATGGTACAGAGGGAGTAGTACCAAATTATACACTTATAATGTACATATACCGTGGTAGAAAGG
TGGTTTCCTGTGATTGCTGTACAGACTCATGATAGTTTGTGATGAAATGTGTAGCTCGCAATTCCA
TATATGAAGAATGAATGCATTCGCTGCTAAAAAAAAAAAAAAAAAAAAA

SEQ ID NO: 160, PRT - Hordeum vulgare
MAMASFRLLPLALLLSVAHARTPRLEPTIRLPSQRAAGQEDDDSVGTRWAVLIAGSNGYYNYRHQA
DICHAYQIMKKGGLKDENIIVFMYDDIARNPENPRPGVIINHPQGGDVYAGVPKDYTGKEVNVKNF
FAVLLGNKTAVNGGSGKVVDSGPNDHIFVFYSDHGGPGVLGMPTYPYLYGDDLVDVLKKKHAAGTY
KSLVFYLEACESGSIFEGLLPNDIGVYATTASNAEESSWGAYCPGEYPSPPPEYDTCLGDLYSISW
MEDSDVHNLRTESLKQQYNLVKKRTAAQDSYSYGSHVMQYGSLDLNAEHLFSYIGSNPANENTTFV
EDNALPSLSRAVNQRDADLVYFWQKYRKLAESSPAKNNARKQLLEMMGHRSHIDSSVELIGNLLFG
SAGGPMVLKTVRPAGEPLVDDWSCLKSTVRTFESQCGSLAQYGMKHMRSFANMCNAGIVPEAMAKV
AAQACTSFPTNPWSATHKGFSA

SEQ ID NO: 161, DNA - Glycine max
GGGTAGGAGATACTCTCATTCACCTCCCATCATCATTATAATCATTCATTCCAACCTACCCTTATT
CTTCTTCTTCAATTTCACACCCATCATGGACCGTTTTCCGATCCTCTTTCTCGTCGCCACCCTCAT
CACCCTCGCCTCCGGTGCCCGCCACGATATTCTCCGGTTACCCTCCGAAGCTTCCAGGTTCTTCAA
AGCACCTGCTAATGCCGATCAAAACGATGAGGGCACCAGGTGGGCCGTTTAGTTGCCGGTTCCAA
TGGCTACTGGAATTACAGGCACCAGTCTGATGTTTGCCATGCATATCAACTACTGAGGAAAGGTGG FIGURE 8 (continued)

```
TGTGAAAGAGGAAAATATTGTTGTATTTATGTATGATGACATTGCTTTCAATGAAGAGAACCCGCG
ACCTGGAGTCATTATTAACAGTCCACATGGAAATGATGTTTACAAGGGAGTTCCTAAGGATTACGT
TGGTGAAGATGTTACTGTTGACAACTTTTTGCTGCTATACTTGGAAATAAGTCAGCTCTTACTGG
TGGCAGTGGGAAGGTTGTGGATAGTGGCCCCAATGATCATATATTTATATACTACTCTGATCATGG
CGGTCCGGGAGTGCTAGGGATGCCTACTAATCCATACATGTATGCATCCGATCTGATTGAAGTCTT
GAAGAAGAAGCATGCTTCTGGAACTTATAAAGCCTAGTATTTTATCTAGAGGCATGTGAATCTGG
GAGTATCTTTGAAGGTCTTCTTCCAGAAGGTCTGAATATCTATGCAACAACAGCTTCAAATGCAGA
AGAAAGCAGTTGGGGAACATATTGTCCTGGGGAGTATCCTAGTCCTCCCTCTGAATATGAAACCTG
CCTGGGTGACCTGTACAGTGTTGCTTGGATGGAAGACAGTGACATACACAATTTGCAAACAGAAAC
TTTACATCAACAATACGAATTGGTCAAACAAAGGACTATGAATGGAAATTCAATTTATGGTTCCCA
CGTGATGCAGTATGGTGACATAGGGCTTAGCGAGAACAATCTCGTCTTATATTTGGGTACAAATCC
TGCTAATGATAATTTTACTTTTGTGCTTAAAAACTCATTGGTGCCACCTTCAAAAGCAGTCAACCA
ACGTGATGCAGATCTCATCCATTTTTGGGATAAGTTCCGCAAAGCTCCTGTGGGTTCTTCTAGGAA
AGCTGCAGCTGAGAAACAAATTCTTGAAGCAATGTCTCACAGAATGCATATAGATGACAGCATGAA
ACTTATTGGAAAGCTCTTCTTTGGCATTGAAAAGGGTCCAGAACTGCTTAGCAGTGTTAGACCTGC
TGGGCAACCACTTGTTGATGACTGGGACTGCCTTAAAACACTGGTTAGGACTTTTGAGACACATTG
TGGATCTCTGTCTCAGTATGGGATGAAACATATGAGGTCCTTTGCAAACTTCTGCAACGCTGGAAT
ACGGAAAGAGCAAATGGCTGAGGCCTCGGCACAAGCATGTGTCAGTATCCCTGCAAGTTCCTGGAG
TTCTCTGCACAGGGGTTTCAGTGCATAATTCCTAGAATCCGCTCCATTGAAGACAGAGTATAGTCG
TTGTAACATTATTCTTTACGAGCGTTATGGACTGTACCTGGACATGATTTCTTATACCAACCCTGT
AAATAAGCATGGGACGCTGGGGAAACCTCTTTACATTATAGTTTCCTGCAAAATAGATGCTGTAAC
AAAGACATTTTACTTTTACTTGGGGAGAGGCAGTGGAACCATAAGGACCCTTGGAACTTCTAATTA
ATACGACAGGGCACAATACCGTGTTTGTAAGCCAACGCTTTGTTTCAATTTAATGGTAACCCCGTT
GTGTA
```

SEQ ID NO: 162, PRT - Glycine max
```
MDRFPILFLVATLITLASGARHDILRLPSEASRFFKAPANADQNDEGTRWAVLVAGSNGYWNYRHQ
SDVCHAYQLLRKGGVKEENIVVFMYDDIAFNEENPRPGVIINSPHGNDVYKGVPKDYVGEDVTVDN
FFAAILGNKSALTGGSGKVVDSGPNDHIFIYYSDHGGPGVLGMPTNPYMYASDLIEVLKKKHASGT
YKSLVFYLEACESGSIFEGLLPEGLNIYATTASNAEESSWGTYCPGEYPSPPSEYETCLGDLYSVA
WMEDSDIHNLQTETLHQQYELVKQRTMNGNSIYGSHVMQYGDIGLSENNLVLYLGTNPANDNFTFV
LKNSLVPPSKAVNQRDADLIHFWDKFRKAPVGSSRKAAAEKQILEAMSHRMHIDDSMKLIGKLFFG
IEKGPELLSSVRPAGQPLVDDWDCLKTLVRTFETHCGSLSQYGMKHMRSFANFCNAGIRKEQMAEA
SAQACVSIPASSWSSLHRGFSA
```

SEQ ID NO: 163, DNA - Glycine max
```
GAGAGCAATGCTTTTCCCGGAAAGGAGAGAGACATAAAAAAGTTCCAAGAAAGAATCACAGAAT
TTTCGCAGAAGCAGGCCAAGAATACACGCATCCCAAACCGTTATTAACGTGTCAGCCTCTAAATTT
GCATGGCATATTGTCTTTAACTGAGTCAATTCCTAATAAACCCTCTGCTTTACCAACCCTGTTCT
CACTCATTCACATACTATAATACTACGATAGCGTAGACTCTTCCCAGTTCTGTTGTGTGAGTCTGT
GAGTCTTTCTTAGCTGATATGGCGGTTGATCGCTCCCTTACGAGGTGCTGTAGCCTCGTACTGTGG
TCGTGGATGTTGCTGAGGATGATGATGGCGCAGGGTGCAGCCGCGAGGGCCAACCGGAAGGAGTGG
GACTCGGTCATAAAGTTACCGGCTGAACCGGTCGATGCTGACTCGGATCATGAAGTGGGAACACGA
TGGGCGGTTCTTGTGGCTGGTTCAAACGGCTATGGAAACTACAGGCATCAAGCAGATGTGTGCCAT
GCGTACCAGTTGCTGATAAAGGTGGGCTAAAAGAAGAGAACATAGTGGTGTTTATGTACGATGAC
ATAGCTACAGACGAGTTAAATCCCAGACCTGGAGTCATCATCAACCACCCTGAGGGACAAGATGTG
TATGCTGGTGTTCCTAAGGATTACACCGGTGATAATGTGACGACGGAGAACCTCTTTGCTGTTATT
```

```
CTTGGAGACAAGAGTAAATTGAAGGGAGGAAGTGGCAAAGTGATCAACAGCAAACCCGAGGACAGA
ATATTTATATACTACTCTGATCATGGAGGTCCTGGAATACTTGGGATGCCAAACATGCCATACCTT
TATGCCATGGATTTTATTGATGTCTTGAAGAAGAAACATGCATCTGGAAGTTACAAGGAGATGGTT
ATATACGTGGAAGCTTGTGAAAGTGGGAGCGTGTTTGAGGGTATAATGCCTAAGGATCTGCAGATT
TATGTCACAACTGCATCCAATGCACAAGAGAATAGTTGGGGAACTTATTGTCCTGGAATGGATCCT
TCTCCACCTCCAGAGTACATCACTTGCCTAGGGGATTTGTACAGTGTTGCTTGGATGGAAGATAGT
GAGACTCATAATCTAAAAGGGAGTCCGTGAAACAACAATACAAATCGGTAAAGCAACGGACTTCA
AATTTCAACAACTATGCGATGGGTTCTCATGTGATGCAATACGGTGACACAAACATCACAGCTGAA
AAGCTTTATTTATACCAAGGTTTTGATCCTGCCGCTGTGAACTTCCCTCCACAAAACGGAAGGCTA
GAAACTAAAATGGAAGTTGTTAACCAAAGAGATGCAGAACTTTTCTTCATGTGGCAAATGTATCAG
AGATCAAACCATCAGCCAGAAAAGAAGACAGACATCCTCAAACAGATAGCGGAGACAGTGAAGCAT
AGGAAACACATAGATGGTAGCGTGGAATTGATTGGAGTTTTATTGTATGGACCAGGAAAAGGTTCT
TCTGTTCTACAATCCATGAGGGCTCCTGGTCTTGCCCTTGTTGATGACTGGACATGCCTAAAATCA
ATGGTTCGGGTGTTTGAGACTCACTGTGGGACACTGACTCAGTATGGCATGAAACACATGCGAGCA
TTTGCCAACATTTGCAACAGTGGCGTTTCTGAGGCCTCCATGGAAGAGGCTTGTTTGGCAGCCTGT
GAAGGCTACAATGCTGGGCTATTGCATCCATCAAACAGAGGCTACAGTGCTTGATTTTGGGTTTTG
TACACAAAAGCTTTAAAGCCCGGTTGATGATGTAATATTTCTCTATTGCATTCTGCCTACTGGTTT
CTGCTGCTTGTGTCAAATTTTCTCTAAACTAGAGTAGCCCAATAGCATACGTGTTATGTGCATTGG
TCATGTATACAAGTGTAATACTAAAACCTTCTACATAATATAAGATTAGTTAGTTTGGTTTAAAAA
AAAAAAAGGGTCTGTTGCAAGCTCTATTTTCTTGACGGCAACTCCTTCTAAGTCAAGGAGATTTTT
CCAAAAAAAAAAAAAAAAAA
```

SEQ ID NO: 164, PRT - Glycine max
```
MAVDRSLTRCCSLVLWSWMLLRMMMAQGAAARANRKEWDSVIKLPAEPVDADSDHEVGTRWAVLVA
GSNGYGNYRHQADVCHAYQLLIKGGLKEENIVVFMYDDIATDELNPRPGVIINHPEGQDVYAGVPK
DYTGDNVTTENLFAVILGDKSKLKGGSGKVINSKPEDRIFIYYSDHGGPGILGMPNMPYLYAMDFI
DVLKKKHASGSYKEMVIYVEACESGSVFEGIMPKDLQIYVTTASNAQENSWGTYCPGMDPSPPPEY
ITCLGDLYSVAWMEDSETHNLKRESVKQQYKSVKQRTSNFNNYAMGSHVMQYGDTNITAEKLYLYQ
GFDPAAVNFPPQNGRLETKMEVVNQRDAELFFMWQMYQRSNHQPEKKTDILKQIAETVKHRKHIDG
SVELIGVLLYGPGKGSSVLQSMRAPGLALVDDWTCLKSMVRVFETHCGTLTQYGMKHMRAFANICN
SGVSEASMEEACLAACEGYNAGLLHPSNRGYSA
```

SEQ ID NO: 165, DNA - Glycine max
```
AAAATGCCCACTTTTTTCTTCCAACGCTCCTCCTCCTTCTCATAGCCTTCGCCACCTCTGTCTCC
GGCCGCCGTGACCTCGTCGGAGACTTTCTCCGGCTGCCCTCCGAAACTGATAACGACGACAACTTC
AAGGGCACCCGGTGGGCCGTCCTCCTCGCCGGTTCCAATGGTTACTGGAATTACAGACATCAGGCT
GATGTTTGTCACGCCTATCAAATATTGAGGAAAGGTGGTCTGAAAGAAGAAATATTATTGTTTTT
ATGTATGATGACATTGCATTCAATGGGGAAAACCCAAGGCCTGGAGTCATCATTAACAAACCAGAT
GGAGGTGATGTTTATAAAGGAGTTCCAAAGGATTACACCGGCGAAGATGTTACTGTTGATAACTTT
TTTGCTGCTTTACTTGGAAATAAGTCAGCACTGACTGGTGGCAGTGGGAAGGTTGTGGACAGTGGT
CCTGATGATCATATATTTGTATACTATACTGACCATGGAGGTCCTGGGGTGCTCGGGATGCCTGCT
GGTCCTTACTTATACGCGGATGATCTGATTGAAGTCTTGAAGAAAAAGCATGCTTCTGGAACATAT
AAAAACCTAGTATTTTATCTGGAGGCATGTGAATCTGGGAGTATCTTTGAAGGTCTTCTTCCTGAA
GATATCAATATTTATGCAACCACTGCTTCCAATGCAGAAGAAAGTAGTTGGGGAACATATTGCCCC
GGGGAGTATCCTAGTCCTCCCCCAGAATATACAACCTGTTTGGGTGACTTGTACAGTGTTGCTTGG
ATGGAAGACAGTGACAGACACAATTTGCGAACAGAAACTCTGCACCAACAATATAAATTGGTTAAA
GAGAGGACTATATCTGGAGATTCATACTATGGCTCTCACGTGATGCAGTATGGTGATGTACGGCTT
```

```
AGCAGTGATGTTCTCTTCCATTATTTGGGTACAGATCCTGCTAATGATAATTTCACTTTTGTGGAT
GAAAACTCCTTATGGTCACCTTCAAAACCAGTCAACCAACGTGATGCTGATCTCATCCATTTTGG
GATAAGTTCCGCAAAGCTCCTGAGGGTTCTCTCAGGAAAAATACAGCTCAGAAACAAGTTTTGGAA
GCAATGTCTCACAGAATGCATGTAGACAACAGTGTAAAACTGATTGGGAAGCTTTTATTTGGCATT
GAAAAGGGTCCAGAAGTACTCAACGCTGTTAGACCGGCTGGATCGGCACTTGTTGATGACTGGCAC
TGCCTGAAAACCATGGTGAGGACTTTTGAGACACATTGTGGATCCTTGTCTCAATATGGCATGAAA
CACATGAGGTCCTTTGCAAACATCTGCAATGTAGGGATAAAGAATGAGCAAATGGCTGAGGCCTCT
GCACAAGCTTGTGTCTCTATTCCTTCCAATCCTTGGAGTTCTCTGCAAAGGGGTTTCAGTGCATAA
TAATTCCTGTAATGTGCACCAGTAAAGACCAAAGTATGATTATTGTTACATTATGCTATATGATTG
TACTTGTATATACATATTTTGTCCCGCCTTTGTAAATACAATTGGGACACTACTAGGATTGGGAAG
AAGGGTCTTTACATTTTTAGTTTGGCAAATAGATATTGCAACTACCTTTGTATAAATCTATTTCTG
AAGAAGCAATTACAACTTTCAAGGGATGATAGCATTTTGTGGCATAAGGATTAAGGAGGCATAAAG
GACCAATTGCTTTGGAATATTCACTCATGACAAGGCACAAGGTCATGCGTGTATGCCAACACATAG
TAATGATGTGTGTTTTTATTCAGTAGGCAACTGGCAGATCGGGTTTTCCCTTGTCACTTTTGTATA
ATTATTTTGGAAGAATTTATGATGTCAAAGTTATTGTTTAATATTAATGGCGACATTGTATTTATT
ATTTGTAAAATAAGAAAAAAGGTGAAATATAGAGTGAAGAAGAAGAAATAGAGGGTTTTGGTGTT
TGAATCGTGAAAATGTTCAGAAACCAGTACGACACGGACGTGACGACATGGAGCCCGGCGGGGAGG
CTGTTCCAGGTGGAGTACGCGATGGAGGCGGTGAAGCAGGGCTCGGCGGCGATAGGGCTCCGATCC
AAGACCCACGTGGTCCTCGCATGCGTCAACAAGGCTAACTCCGAACTCTCATCGCACCAGAAGAAG
ATCTTCAAGGTCGACAACCACATCGGCGTCGCCATCGCCGGCCTCACCGCCGACGGCCGCGTCCTC
TCCCGCTACATGCGATCCGAGTGCATCAACTATAACTACACCTACGAGTCACCGCTCCCCGTAGGG
AGACTCGTCGTTCAGCTCGCCGATAAGGCTCAGGTTTGCACCCAGCGGTCATGGAAACGTCCTTAT
GGAGTTGGACTCCTGGTAGCTGGATTAGATGAATCAGGAGCTCACCTCTATTACAACTGTCCCAGT
GGAAACTATTTTGAATATCAGGCTTTTGCTATTGGGTCTCGCTCTCAAGCTGCAAAGACATATTTG
GAACGCAGGTTTGAGAATTTTGTGGCTCTTCACGAGAAGATCTGATCAAAGATGCACTTATTGCA
ACTAGGGAGTCCTTGCAAGGTGAAAAACTCAGGAGTTCTGTGTGCACAATTGCTGTGGTTGGTGTT
GGTGAGCCATTCCACATTTTGGATCAGGAAACTGTTCAACAGTTGATTGATACTTTTGAGATTGTG
AGGGAGGAAGAAGCTGCTCCAGCTGAAGAAGAAGCTCAGCCAGCAGCCGAACAGGATGCTCCCACA
GATCCAGGTGCTGCTGCTGCAGATCAAGGTGGTGGTTGCTGCTGCTGTAGACCAAGGTGGTTCTCC
TATGGACATTTGATAATTTAAAATTAAGTACTAGAGGTGTTGAATACCAATATTTAAAGACGAGTA
GGTTTCATGTGTCATGGGACAAGATATTTCTTTGATGGAATTTTTTTCCCCTTAATCCTGTTTGTT
TTTTCAATTCATCCATGCCTGATCATTGTAAACGATTTTATAGCTGTTTGATGAACTTGAATGCAT
GATTTACAATAATTAATTGAAATTCAGGC
```

SEQ ID NO: 166, PRT - Glycine max
```
MPTFFLPTLLLLLIAFATSVSGRRDLVGDFLRLPSETDNDDNFKGTRWAVLLAGSNGYWNYRHQAD
VCHAYQILRKGGLKEENIIVFMYDDIAFNGENPRPGVIINKPDGGDVYKGVPKDYTGEDVTVDNFF
AALLGNKSALTGGSGKVVDSGPDDHIFVYYTDHGGPGVLGMPAGPYLYADDLIEVLKKKHASGTYK
NLVFYLEACESGSIFEGLLPEDINIYATTASNAEESSWGTYCPGEYPSPPPEYTTCLGDLYSVAWM
EDSDRHNLRTETLHQQYKLVKERTISGDSYYGSHVMQYGDVRLSSDVLFHYLGTDPANDNFTFVDE
NSLWSPSKPVNQRDADLIHFWDKFRKAPEGSLRKNTAQKQVLEAMSHRMHVDNSVKLIGKLLFGIE
KGPEVLNAVRPAGSALVDDWHCLKTMVRTFETHCGSLSQYGMKHMRSFANICNVGIKNEQMAEASA
QACVSIPSNPWSSLQRGFSA
```

FIGURE 8 (continued)

SEQ ID NO: 167, DNA - Brassica napa
TCATCACCTTATTGATTGGTTGACAAAAAACAAACAGATAAGAAAAGAAAAGATTCATTATTTAAT
AGTTCCCCCGCCGATTAAAAGATTCGTATCCACGTCACCATACGCCTCTCCAACGATGACACCTGT
CGCCGTCGCCGTTCTCGTCCTCTCCTTGATCGCCGTCTCCGCCGCAAGACAAAACCCCGACGACGA
CGTCATCAAACTCCCCTCGCAAGCTTCCAGGTTCTTCCGCCCCAACAACGACGACGAATCTTCATC
GTCCGGCACCAGGTGGGCCGTTCTGGTCGCCGGATCGAGCGGTTATTGGAACTACAGACATCAGGC
TGATGTTTGTCATGCTTATCAACTACTGAGGAAAGGAGGATTGAAAGAGGAGAATATTGTGGTTTT
CATGTATGATGATATTGCTGATAATGAAGAGAATCCGAGGAAAGGGATCATTATCAATAGCCCTCA
TGGGAGTGATGTCTATGAAGGAGTTCCCAAGGATTACACTGGAGATGATGTTACTGTTGATAATCT
GTTTGCTGTGATCCTTGGAGATAAAACTGCTGTTAAGGGAGGGAGTGGGAAGGTTGTGGATAGTGG
TCCTAATGATCATATTTTTATATTCTATAGTGACCATGGTGGTCCTGGAGTTCTTGGGATGCCGAC
TTCTCCTTACTTATATGCTGATGACTTGAATGATGTCTTGAAGAAAAAACATGCTTCCGGAACCTA
CAAAAGCATGGTGTTCTATCTTGAAGCTTGTGAGTCTGGAAGTATCTTTGAAGGGCTTCTTGAAGA
GGGTTTAAACATCTACGCCACAACTGCATCAAACGCAGTGGAAAGCAGTTGGGGTACCTATTGCCC
TGGGGAGGAGCCTAGCCCTCCACCGGAGTATGAAACTTGCTTAGGTGACTTATACAGTGTTGCATG
GATGGAAGACAGCGGTGTGCACAATCTACAAACTGAGACTCTACGCCAACAATATGAGCTAGTGAA
GAGGAGGACTGCTGGTGGTGCGTCGGCTTACGGTTCTCATGTGATGCAATATGGAGATGTAGGACT
TAACAAGGATAAGCTCGACCTTTACATGGGAACAAACCCTGCCAATGACAACTTCACTTTTGTGGA
TGCTAATTCACTGACTCCACCTTCAGGAGTTACTAACCAGCGTGATGCAGATCTTGTCCATTTCTG
GGATAAGTACCGAAAGGCACCAGAAGGTTCCACAAGGAAAACAGAAGCTCAGAAGCAAGTCCTTGA
AGCCATGTCTCACAGACTTCATGTTGACAACAGTGTGAAACTCGTCGGCAAACTCTTGTTTGGTAT
CTCAGAAGGTTCTGAAGTGCTAAACAAAGTAAGGCCTGCTGGACAACCTCTGGCCGATGACTGGAC
TTGCCTTAAAAACACGGTGAGAGCTTTTGAGAGACACTGTGGGTCGCTGTCACAGTACGGTATCAA
GCACATGAGGTCATTTGCAAACATCTGCAACGCAGGGATCCAAATGGAGCAAATGGAAGAGGCAGC
TTCACAGGCTTGCACCTCAATCCCATCTGGTCCTTGGAGCTCTCTTCACCGTGGATTCAGTGCTTA
AAACCCCTAAATCCCTCTTTGCATTTGTTTAATACTAGTACCAATACCCAAATATTCCTATTTCGA
TTCCCCTGTATATCTCATTATCATTTCCCTCTTGATTATCTAATTACAGATTATACATATGCTTTG
TACAAAATGCTTGTAGAAACTCAAGTTAATGTAAACAACG

SEQ ID NO: 168, PRT - Brassica napa
MTPVAVAVLVLSLIAVSAARQNPDDDVIKLPSQASRFFRPNNDDESSSSGTRWAVLVAGSSGYWNY
RHQADVCHAYQLLRKGGLKEENIVVFMYDDIADNEENPRKGIIINSPHGSDVYEGVPKDYTGDDVT
VDNLFAVILGDKTAVKGGSGKVVDSGPNDHIFIFYSDHGGPGVLGMPTSPYLYADDLNDVLKKKHA
SGTYKSMVFYLEACESGSIFEGLLEEGLNIYATTASNAVESSWGTYCPGEEPSPPPEYETCLGDLY
SVAWMEDSGVHNLQTETLRQQYELVKRRTAGGASAYGSHVMQYGDVGLNKDKLDLYMGTNPANDNF
TFVDANSLTPPSGVTNQRDADLVHFWDKYRKAPEGSTRKTEAQKQVLEAMSHRLHVDNSVKLVGKL
LFGISEGSEVLNKVRPAGQPLADDWTCLKNTVRAFERHCGSLSQYGIKHMRSFANICNAGIQMEQM
EEAASQACTSIPSGPWSSLHRGFSA

SEQ ID NO: 169, DNA - Brassica napa
TTTACACAGAGAGAGCAAAACAACAGTTCTTTAGAGTAATTTTCTGACAATGTCTTCTCTTGGTCA
TTTACTTGTTCTTGTGTTTCTCTATGTTCTGCTTTTTTACTCAGCTGATTCTCGCAAACCCCAAGT
CCTTCATGACACTGGATCTAGCGAAGATGGTGCAAAAGGCACAAGATGGGCTGTTCTAATTGCTGG
ATCAAGTTATTATTATAACTACAGGCATCAGGCTGACATATGCCATGCATATCAAGTTCTGCGAAA
AGGGGGTCTAAAAGATGAAAACATTATTGTGTTTATGTATGATATCGCGTTTAACCCTGAGAA
TCCCAGGCCTGGAGTTATCATCAATAGACCTGATGGTGGAGATGTTTATGAAGGCGTTCCTAAGGA
CTACACTAAAGAGGCTGTTAATGTGAAGAACTTTTATAATGTGATACTTGGAAACGAAAGTGGCAT

FIGURE 8 (continued)

```
CACAGGAGGAAGTGGCAAAGTTGTGAAAAGTGGTCCTAATGATAGTATATTCATCTACTATGCTGA
CCATGGAGCTCCTGGTTTACTATCGATGCCTGATGGTGAAGATATCCATGCAAAAGATTTCATTAA
AGTCTTGGAGAAGATGCATAAGCTTAAAAGATACAAGAAGATGGTGATTTATGTTGAAGCATGTGA
GTCTGGAAGTATGTTTGAAGGGATTTTAAAGACCAATCTAAACATACTTGCAGTAACTGCTTCTAA
TGCGACAGAGAGCAGTTTTGGAATCTACTGTCCTGGTGAATATCCTCCTCCTCCTGAATATAA
TGGTGTTTGTCTCGGCGATACATTTAGCGTCTCTTGGCTTGAGGACAGTGAGCTTCATGACATGAG
TAAAGAGACATTGAAGCAGCAATACCAAGCTGTAAAGAGAAGAACAGGTCCTGATGCTGAACCAGG
GACGAGTTCTCATGTAAGCCGTTTCGGATCAAAGGCGCTTCTTAAAGACTATCTTGTCTCTTACAT
TGGAACCAATCCTGATAACGAAAACTTCACTTTTGCTGGATTCACTGCTTCACCAATCTCTACTTC
AAGCTCGGTCAATACTCGCGATATCCCTTTGTTATATCTCAAGAGCAAGATTCAAAGATCTCCAAT
GGAGTCACCTGAAAGACAAGAGCTTCAGAAGAAGCTGTTTGAAGAAATGAATCATAGGAGACAAAT
CGATCAGAACATTGTGGAGATTCTTAAACTTTCACTTAAGCAAACCAATGTCTTAAATCTCTTAAT
TTCCACAAGAACAACAGGACAACCTCTTGTAGACGACTGGGATTGCTTCAAGACTCTGGTTAATAG
CTTCAAGAATCACTGTGGAGCAACGATGGATTACGGATTGAAGTATACAGGAGCGCTTGCCAATAT
CTGCAATATGGGAGTGGATGTGAAGCAAACTGTTTCAGCTATTGAACACGTTGTGCACATTAAAT
GAAATGATGTGCATAAATAATGTGATCGACTTAAAAAATATGAAAGTTATTGCATTAAGATATATG
AACTGTCGAGATGGTTGATGATGCCTATTTTTACTTTAATAAAAAATTTAGTTGGTAACGCGAAAA
AAAAAAAAAAAACCGCCCCT
```

SEQ ID NO: 170, PRT - Brassica napa
```
MSSLGHLLVLVFLYVLLFYSADSRKPQVLHDTGSSEDGAKGTRWAVLIAGSSYYYNYRHQADICHA
YQVLRKGGLKDENIIVFMYDDIAFNPENPRPGVIINRPDGGDVYEGVPKDYTKEAVNVKNFYNVIL
GNESGITGGSGKVVKSGPNDSIFIYYADHGAPGLLSMPDGEDIHAKDFIKVLEKMHKLKRYKKMVI
YVEACESGSMFEGILKTNLNILAVTASNATESSFGIYCPGEYPPPPPEYNGVCLGDTFSVSWLEDS
ELHDMSKETLKQQYQAVKRRTGPDAEPGTSSHVSRFGSKALLKDYLVSYIGTNPDNENFTFAGFTA
SPISTSSSVNTRDIPLLYLKSKIQRSPMESPERQELQKKLFEEMNHRRQIDQNIVEILKLSLKQTN
VLNLLISTRTTGQPLVDDWDCFKTLVNSFKNHCGATMDYGLKYTGALANICNMGVDVKQTVSAIEH
ACAH
```

SEQ ID NO: 171, DNA - Zea mays
```
TCCACTCTCGCTCCCTCTCCCTCCCTTCCCTCCCACGCAAATGGTGGCCGCTCGCCTCCGCCTCTC
GCTGCTACTCTCCGTCTGCCTCTCCTCCGCGTGGGCGCGCCCACGCCTCGAGCCGGCCATCCGCCT
GCCGTCGCAGCGCGCCGCGGCGGCCGACGAAACGGACGACGGCGACGTCGGGACCCGCTGGGCCGT
GCTCATCGCCGGCTCCAACGGCTACTACAACTACCGCCACCAGGCGGACATCTGCCATGCATACCA
GATCATGAAGAAGGGCGGACTTAAGGACGAGAACATCGTTGTCTTCATGTACGATGACATCGCGCA
TAGCCCGGAAAATCCGAGGCCTGGTGTCATCATAAATCATCCCCAGGGTGGCGACGTCTATGCTGG
GGTGCCAAAGGATTACACTGGGCGAGAGGTCAACGTCGACAATTTCTTCGCTGTTCTGCTTGGCAA
CAAAACTGCTCTCAGGGGTGGGAGCGGCAAGGTTGTGGACAGTGGCCCCAATGATCATATATTTGT
TTTCTACAGTGACCATGGGGTCCTGGTGTCCTTGGAATGCCTACGTATCCATATCTCTATGGTGA
TGACCTCGTAGATGTCCTGAAGAAGAAGCATGCTGCCGGGACCTACAAAGCCTGGTCTTTTACCT
TGAAGCGTGCGAATCTGGGAGCATCTTTGAGGGCCTCCTGCCGAATGACATCAATGTGTATGCGAC
CACCGCGTCAAATGCAGAGGAGAGTAGCTGGGGACGTACTGCCCTGGCGAGTTCCCGAGCCCTCC
ACCGGAGTATGACACTTGCTTGGAGACCTGTATAGTGTTGCTTGGATGGAAGACAGTGATTTCCA
CAATCTGCGAACTGAATCTCTCAAGCAGCAATACAACTTGGTCAAGGATAGGACAGCGGTTCAGGA
TACATTCAGCTATGGCTCCCATGTGATGCAATATGGTTCATTGGAGTTGAATGTTAAGCATCTGTT
TTCGTACATTGGCACAAACCCTGCTAACGATGACAACACGTTTATAGAAGACAACTCGTTGCCATC
ATTCTCAAAGGCTGTTAATCAGCGCGACGCTGACCTTGTCTACTTCTGGCAGAAGTACCGGAAATT
```

```
GGCAGACAGCTCACCTGAGAAAAATGAAGCTCGGAGGGAGTTGCTTGAAGTGATGGCCCACAGGTC
TCATGTTGACAGCAGTGTTGAGCTCATTGGAAGCCTTCTCTTTGGCTCTGAGGACGGTCCAAGGGT
TCTGAAAGCCGTCCGTGCAGCTGGTGAGCCTCTGGTCGATGATTGGAGCTGTCTCAAGTCCACGGT
TCGTACTTTTGAGGCGAATGTGGGTCGTTGGCGCAGTATGGGATGAAGCACATGCGGTCCTTCGC
AAACATCTGCAACGCTGGCATCCTTCCTGAGGCAGTGTCGAAGGTCGCTGCTCAGGCTTGCACCAG
CATTCCTTCCAACCCCTGGAGTTCTATCCACAAGGGTTTTAGCGCCTAAGAATCATAAGGTGAGGC
GAAATATTTCAGCCGCTCCACCGCAACGAACTGGTTTACATTACCAGTCCTCAGGGGGTCCTAGT
TCTTGAACCATAGGTGAAGCAGACTTATACCACTATTATAGCTGTTCCACCGTCGTTCCAGATTAC
ATAGCTATGCCCAATTTCCGGTGTACATATATAGTCGGAAAGTTATTTGGCAATTGTATTGGTCGT
TGCTGTATATATTCCCTATAGTTTGTTAGCAGATGTGTAGTTTGTAATTCCATAAAAATGAAGGAC
GCGTTACTGCTATTTCTATGTAGCCGACTGGTGCTCATGTGAAACTTTACCCCATTCTTGTTGGGA
AATGTACTATCCGTGGTGGAATTCTTGCATCGAAAACAATTCCCGGGTGGTCCTTTATTCAAAAAA
AAAAAAAAAAAAGCGGCCGGTGCTAGAGG
```

SEQ ID NO: 172, PRT - Zea mays
```
MVAARLRLSLLLSVCLSSAWARPRLEPAIRLPSQRAAAADETDDGDVGTRWAVLIAGSNGYYNYRH
QADICHAYQIMKKGGLKDENIVVFMYDDIAHSPENPRPGVIINHPQGGDVYAGVPKDYTGREVNVD
NFFAVLLGNKTALRGGSGKVVDSGPNDHIFVFYSDHGGPGVLGMPTYPYLYGDDLVDVLKKKHAAG
TYKSLVFYLEACESGSIFEGLLPNDINVYATTASNAEESSWGTYCPGEFPSPPPEYDTCLGDLYSV
AWMEDSDFHNLRTESLKQQYNLVKDRTAVQDTFSYGSHVMQYGSLELNVKHLFSYIGTNPANDDNT
FIEDNSLPSFSKAVNQRDADLVYFWQKYRKLADSSPEKNEARRELLEVMAHRSHVDSSVELIGSLL
FGSEDGPRVLKAVRAAGEPLVDDWSCLKSTVRTFEAQCGSLAQYGMKHMRSFANICNAGILPEAVS
KVAAQACTSIPSNPWSSIHKGFSA
```

SEQ ID NO: 173, DNA - Arabidopsis thaliana
```
ATGACCACCGTCGTTTCCTTTCTCGCCCTCTTCCTCTTTCTAGTCGCCGCCGTTTCTGGTGACGTC
ATCAAACTTCCTTCTCTAGCTTCTAAGTTCTTCCGCCCAACTGAAAACGACGATGATTCTACTAAG
TGGGCTGTTCTCGTCGCCGGATCCAGCGGATACTGGAATTATCGTCATCAGGCGGATGTTTGTCAT
GCTTATCAGCTTTTGAAGAAAGGTGGAGTGAAAGAGGAGAATATTGTGGTGTTTATGTATGATGAC
ATTGCGAAGAACGAGGAGAATCCAAGACCTGGAGTTATTATCAATAGTCCTAATGGAGAGGATGTC
TATAATGGAGTTCCCAAGGATTACACTGGAGATGAAGTTAATGTTGATAACTTATTAGCTGTGATT
CTTGGAAACAAAACGGCTCTTAAAGGAGGAAGTGGGAAAGTTGTAGATAGCGGTCCAAACGATCAT
ATCTTTATATACTATAGTGATCACGGTGGTCCGGGAGTGCTCGGGATGCCAACTTCTCCAAACCTA
TATGCAAATGATCTCAATGATGTCTTGAAGAAAAAATATGCTTCAGGAACATATAAGAGCTTGGTG
TTTTATTTGGAGGCTTGTGAATCTGGAAGTATTTTGAAGGTCTTTTACCAGAGGGTTTAAATATT
TACGCGACAACTGCATCGAATGCAGAAGAAAGTAGCTGGGGTACTTACTGTCCTGGAGAGGATCCT
AGTCCTCCTTCTGAGTATGAGACCTGTTTGGGTGACTTATACAGTGTTGCTTGGATAGAAGATAGT
GAAAAACACAATTTACAAACAGAGACTTTGCACGAGCAATATGAATTGGTGAAAAGAGAACTGCA
GGTTCTGGTAAGTCTTATGGTTCTCATGTTATGGAATTTGGAGATATAGGACTCAGCAAGGAGAAG
CTTGTCCTTTTTATGGGTACAAATCCAGCAGATGAAAACTTCACCTTTGTGAATGAGAATTCAATA
AGGCCGCCTTCAAGAGTTACAAACCAGCGTGATGCGGATCTTGTCCATTTCTGGCATAAGTATCAA
AAGGCACCGGAAGGGTCAGCAAGAAAAGTTGAAGCTCAGAAGCAAGTCCTTGAAGCAATGTCTCAC
AGACTTCATGTTGATAATAGCATTCTGTTGATTGGGATTCTTTTGTTTGGTTTGGAAGGTCATGCG
GTGTTAAATAAAGTCCGGCCTTCTGGAGAACCGCTTGTTGACGATTGGGACTGCCTTAAATCTCTG
GTGAGAGCTTTCGAGAGGCACTGTGGATCGTTGTCTCAGTACGGAATAAAGCACATGAGGTCGATT
GCAAACATGTGCAACGCAGGGATTCAGATGAGGCAAATGGAGGAGGCAGCAATGCAGGCTTGTCCC
ACCATCCCTACCAGTCCTTGGAGCTCTCTTGACCGTGGATTCAGTGCTTGA
```

SEQ ID NO: 174, PRT - Arabidopsis thaliana
MTTVVSFLALFLFLVAAVSGDVIKLPSLASKFFRPTENDDDSTKWAVLVAGSSGYWNYRHQADVCH
AYQLLKKGGVKEENIVVFMYDDIAKNEENPRPGVIINSPNGEDVYNGVPKDYTGDEVNVDNLLAVI
LGNKTALKGGSGKVVDSGPNDHIFIYYSDHGGPGVLGMPTSPNLYANDLNDVLKKKYASGTYKSLV
FYLEACESGSIFEGLLPEGLNIYATTASNAEESSWGTYCPGEDPSPPSEYETCLGDLYSVAWIEDS
EKHNLQTETLHEQYELVKKRTAGSGKSYGSHVMEFGDIGLSKEKLVLFMGTNPADENFTFVNENSI
RPPSRVTNQRDADLVHFWHKYQKAPEGSARKVEAQKQVLEAMSHRLHVDNSILLIGILLFGLEGHA
VLNKVRPSGEPLVDDWDCLKSLVRAFERHCGSLSQYGIKHMRSIANMCNAGIQMRQMEEAAMQACP
TIPTSPWSSLDRGFSA

SEQ ID NO: 175, DNA - Arabidopsis thaliana
ATGGCTAAGTCTTGCTATTTCAGACCAGCTCTTCTTCTTCTGTTAGTTCTTTTGGTTCATGCCGAG
TCACGCGGTCGGTTCGAGCCAAAGATTCTTATGCCGACAGAGGAAGCTAACCCGGCTGACCAAGAC
GAAGATGGTGTCGGTACAAGATGGGCGGTTCTCGTCGCTGGTTCTTCTGGATATGGAAACTACAGA
CACCAGGCTGACGTGTGTCACGCATATCAAATACTAAGAAAAGGAGGTTTAAAGGAAGAAAACATA
GTCGTTTTGATGTATGATGATATCGCAAACCACCCACTTAATCCTCGTCCGGGTACTCTCATCAAC
CATCCTGACGGTGACGATGTTTACGCCGGAGTCCCTAAGGACTATACTGGTAGTAGCGTTACGGCT
GCAAACTTCTACGCTGTACTCCTAGGCGACCAGAAGGCTGTTAAAGGTGGAAGCGGTAAGGTCATC
GCTAGCAAGCCCAACGATCACATTTTCGTATATTATGCGGATCATGGTGGTCCCGGAGTTCTTGGG
ATGCCAAATACGCCTCACATATATGCAGCTGATTTTATTGAAACGCTTAAGAAGAAGCATGCTTCC
GGAACATACAAAGAGATGGTTATATACGTAGAAGCGTGTGAAAGTGGGAGTATTTTCGAAGGGATA
ATGCCAAAGGACTTGAACATTTACGTAACAACGGCTTCAAATGCACAAGAGAGTAGTTATGGAACA
TATTGTCCTGGCATGAATCCGTCACCCCCATCTGAATATATCACTTGCTTAGGGGATTTATATAGT
GTTGCTTGGATGGAAGATAGTGAGACTCACAATTTAAAGAAAGAGACCATAAAGCAACAATACCAC
ACGGTGAAGATGAGGACATCAAACTACAATACCTACTCAGGTGGCTCTCATGTGATGGAATACGGT
AACAATAGTATTAAGTCGGAGAAGCTTTATCTTTACCAAGGGTTTGATCCAGCCACCGTTAATCTC
CCACTAAACGAATTACCGGTCAAGTCAAAAATAGGAGTCGTTAACCAACGCGACGCGGACCTTCTC
TTCCTTTGGCATATGTATCGGACATCGGAAGATGGGTCAAGGAAGAAGGATGACACATTGAAGGAA
TTAACTGAGACAACAAGGCATAGGAAACATTTAGATGCAAGCGTCGAATTGATAGCCACAATTTTG
TTTGGTCCGACGATGAATGTTCTTAACTTGGTTAGAGAACCCGGTTTGCCTTTGGTTGACGATTGG
GAATGTCTTAAATCGATGGTACGTGTATTTGAAGAGCATTGTGGATCACTAACGCAATATGGGATG
AAACATATGCGAGCGTTTGCAAACGTTTGTAACAACGGTGTGTCCAAAGAGCTGATGGAGGAAGCT
TCTACTGCGGCATGCGGTGGTTATAGTGAGGCTCGCTACACGGTGCATCCATCAATCTTAGGCTAT
AGCGCCTGA

SEQ ID NO: 176, PRT - Arabidopsis thaliana
MAKSCYFRPALLLLLVLLVHAESRGRFEPKILMPTEEANPADQDEDGVGTRWAVLVAGSSGYGNYR
HQADVCHAYQILRKGGLKEENIVVLMYDDIANHPLNPRPGTLINHPDGDDVYAGVPKDYTGSSVTA
ANFYAVLLGDQKAVKGGSGKVIASKPNDHIFVYYADHGGPGVLGMPNTPHIYAADFIETLKKKHAS
GTYKEMVIYVEACESGSIFEGIMPKDLNIYVTTASNAQESSYGTYCPGMNPSPPSEYITCLGDLYS
VAWMEDSETHNLKKETIKQQYHTVKMRTSNYNTYSGGSHVMEYGNNSIKSEKLYLQGFDPATVNL
PLNELPVKSKIGVVNQRDADLLFLWHMYRTSEDGSRKKDDTLKELTETTRHRKHLDASVELIATIL
FGPTMNVLNLVREPGLPLVDDWECLKSMVRVFEEHCGSLTQYGMKHMRAFANVCNNGVSKELMEEA
STAACGGYSEARYTVHPSILGYSA

FIGURE 8 (continued)

SEQ ID NO: 177, DNA - Arabidopsis thaliana
ATGTCTAGTCCTCTTGGTCACTTTCAGATTCTTGTTTTTCTTCATGCTTTGCTTATCTTCTCAGCT
GAGTCCCGCAAAACCCAATTGCTGAACGATAATGATGTTGAATCTAGCGACAAGAGTGCAAAAGGC
ACACGATGGGCTGTTTTAGTTGCTGGATCAAATGAATATTATAACTACAGGCATCAGGCTGACATA
TGCCACGCGTATCAGATACTCCGAAAAGGCGGTTTAAAAGATGAAAACATCATTGTGTTTATGTAT
GATGATATCGCGTTTTCCTCGGAGAATCCTAGGCCTGGAGTTATCATTAATAAACCAGATGGAGAA
GATGTTTATAAAGGAGTTCCTAAGGACTACACTAAAGAAGCTGTTAATGTTCAAAACTTCTACAAT
GTGTTACTTGGAAATGAAAGTGGCGTCACAGGAGGAAATGGCAAAGTTGTGAAAAGTGGTCCTAAT
GATAATATCTTCATCTATTATGCTGACCATGGAGCTCCTGGCTTAATAGCGATGCCCACTGGTGAT
GAAGTTATGGCAAAAGATTTCAATGAAGTCTTGGAGAAGATGCATAAGAGAAAAAAATACAACAAG
ATGGTGATCTATGTTGAAGCATGTGAATCAGGAAGTATGTTTGAAGGGATTTTAAAGAAAAATCTC
AACATATACGCAGTGACTGCTGCTAATTCTAAAGAGAGCAGCTGGGGAGTTTACTGTCCTGAGTCA
TATCCTCCTCCTCCTTCTGAGATTGGAACTTGTCTCGGCGATACATTTAGCATCTCTTGGCTTGAG
GACAGTGACCTTCATGACATGAGCAAAGAGACTTTGGAGCAACAATACCACGTTGTAAAGAGAAGA
GTAGGATCTGATGTACCAGAGACTTCTCATGTATGCCGTTTCGGAACAGAGAAGATGCTTAAAGAT
TATCTTTCCTCTTACATTGGAAGAAATCCTGAAAACGATAACTTCACTTTCACGGAATCCTTTTCC
TCACCAATCTCTAATTCTGGCTTGGTCAATCCGCGCGATATTCCTCTGCTATACCTCCAGAGAAAG
ATTCAAAAGCTCCAATGGGATCACTTGAAAGCAAAGAAGCTCAGAAGAAATTGCTTGACGAAAAG
AATCATAGGAAACAAATCGATCAGAGCATTACAGACATTCTGCGGCTTTCAGTTAAACAAACCAAT
GTCTTAAATCTCTTAACTTCCACAAGAACAACAGGACAGCCTCTTGTAGACGATTGGGATTGCTTC
AAGACTCTAGTTAATAGCTTCAAGAATCACTGCGGTGCAACGGTGCATTACGGATTGAAGTATACA
GGAGCGCTTGCCAATATCTGCAATATGGGAGTGGATGTGAAGCAAACTGTTTCAGCCATTGAACAA
GCTTGTTCGATGTAA

SEQ ID NO: 178, PRT - Arabidopsis thaliana
MSSPLGHFQILVFLHALLIFSAESRKTQLLNDNDVESSDKSAKGTRWAVLVAGSNEYYNYRHQADI
CHAYQILRKGGLKDENIIVFMYDDIAFSSENPRPGVIINKPDGEDVYKGVPKDYTKEAVNVQNFYN
VLLGNESGVTGGNGKVVKSGPNDNIFIYYADHGAPGLIAMPTGDEVMAKDFNEVLEKMHKRKKYNK
MVIYVEACESGSMFEGILKKNLNIYAVTAANSKESSWGVYCPESYPPPPSEIGTCLGDTFSISWLE
DSDLHDMSKETLEQQYHVVKRRVGSDVPETSHVCRFGTEKMLKDYLSSYIGRNPENDNFTFTESFS
SPISNSGLVNPRDIPLLYLQRKIQKAPMGSLESKEAQKKLLDEKNHRKQIDQSITDILRLSVKQTN
VLNLLTSTRTTGQPLVDDWDCFKTLVNSFKNHCGATVHYGLKYTGALANICNMGVDVKQTVSAIEQ
ACSM

SEQ ID NO: 179, DNA - Oryza sativa
ATGGCGGCGCGCTCGCCTCCGCCTCGTCCTGCCCCGCTCGCGGCGCTGCTCCTCTTCGCGCAC
CTCGCCGCCGTCGCGGTGGCGCGGCCGCGGTGGGAGGAGGAGGGCAGCAACCTCCGCCTGCCGTCG
GAGCGCGCCGTGGCGGCTGGCGCGGCGGCGGACGACGCTGCCGAGGCCGCCGAGGGCACCAGGTGG
GCCGTCCTCATCGCCGGCTCCAACGGCTACTACAACTACCGCCACCAGGCGGATGTCTGCCATGCC
TACCAGATCATGAAGAGGGGCGGGCTCAAGGACGAGAACATCATCGTCTTCATGTACGATGACATC
GCGCACAACCCGGAGAATCCGAGGCCTGGTGTCATCATCAACCATCCCCAGGGTGGCGATGTCTAT
GCTGGGGTCCCGAAGGATTACACTGGGAAGGAGGTTAATGTCAAAAACTTGTTTGCTGTTCTGCTC
GGTAACAAAACTGCTGTCAAAGGTGGGAGTGGCAAAGTCCTGGACAGTGGCCCAACGATCATATT
TTCATTTTTTACAGTGACCATGGGGGTCCTGGTGTCCTTGGGATGCCAACCTATCCATACCTCTAC
GGTGATGATCTTGTAGATGTTCTGAAGAAGAAGCATGCTGCTGGGACGTACAAAAGCCTGGTCTTT
TACCTTGAAGCCTGTGAATCTGGAAGCATCTTTGAGGGTCTATTGCCAATGGCATCAATGTTTAT
GCCACCACTGCATCAAACGCTGATGAGAGCAGCTGGGGAACATACTGCCCTGGGGAGTACCCGAGC FIGURE 8 (continued)

```
CCACCTCCGGAGTACGACACATGCCTAGGGGACTTGTACAGCGTTGCTTGGATGGAAGACAGCGAT
GTCCACAACCTGAGAACTGAATCACTCAAGCAGCAGTACAATCTCGTCAAGGAAAGGACATCTGTG
CAGCACACATATTACTCTGGGTCACATGTGATGGAATACGGTTCTTTAGAGCTGAATGCCCATCAT
GTGTTCATGTACATGGGTTCCAATCCGGCTAACGACAATGCTACATTTGTGGAAGATAACTCGTTG
CCATCGTTCTCAAGGGCTGTTAATCAGCGGGATGCTGACCTGGTTTACTTCTGGCAGAAGTACCGC
AAATTGCCTGAGAGTTCTCCTGAGAAAAACGAAGCTCGGAAGCAATTGCTTGAAATGATGGCACAC
AGATCTCATGTTGACAACAGTGTTGAGCTGATCGGAAACCTTCTCTTTGGCTCTGAGGAAGGCCCA
AGGGTTCTAAAGGCTGTTCGTGCAACTGGCGAACCTCTTGTTGATGACTGGAGTTGTCTCAAGTCT
ATGGTACGCACTTTCGAAGCACAATGCGGCTCGCTAGCGCAGTATGGAATGAAGCATATGCGTTCC
TTTGCAAACATCTGCAATGCTGGCATCTCTGCTGAAGCGATGGCAAAGGTTGCTGCGCAGGCTTGC
ACCAGCATTCCCTCCAACCCCTGGAGTTCCACCCATAGGGGTTTTAGTGCTTAA
```

SEQ ID NO: 180, PRT - Oryza sativa
```
MAARARLRLVLPPLAALLLFAHLAAVAVARPRWEEEGSNLRLPSERAVAAGAAADDAAEAAEGTRW
AVLIAGSNGYYNYRHQADVCHAYQIMKRGGLKDENIIVFMYDDIAHNPENPRPGVIINHPQGGDVY
AGVPKDYTGKEVNVKNLFAVLLGNKTAVKGGSGKVLDSGPNDHIFIFYSDHGGPGVLGMPTYPYLY
GDDLVDVLKKKHAAGTYKSLVFYLEACESGSIFEGLLPNGINVYATTASNADESSWGTYCPGEYPS
PPPEYDTCLGDLYSVAWMEDSDVHNLRTESLKQQYNLVKERTSVQHTYYSGSHVMEYGSLELNAHH
VFMYMGSNPANDNATFVEDNSLPSFSRAVNQRDADLVYFWQKYRKLPESSPEKNEARKQLLEMMAH
RSHVDNSVELIGNLLFGSEEGPRVLKAVRATGEPLVDDWSCLKSMVRTFEAQCGSLAQYGMKHMRS
FANICNAGISAEAMAKVAAQACTSIPSNPWSSTHRGFSASPLAQGYSA
```

SEQ ID NO: 181, DNA - Oryza sativa
```
ATGGCGGCGCGCGCTCGCCTCCGCCTCGTCCTGCCCCCGCTCGCGGCGCTGCTCCTCTTCGCGCAC
CTCGCCGCCGTCGCGGTGGCGCGGCCGCGGTGGGAGGAGGAGGGCAGCAACCTCCGCCTGCCGTCG
GAGCGCGCCGTGGCGGCTGGCGCGGCGGCGGACGACGCTGCCGAGGCCGCCGAGGGCACCAGGTGG
GCCGTCCTCATCGCCGGCTCCAACGGCTACTACAACTACCGCCACCAGGCGGATGTCTGCCATGCC
TACCAGATCATGAAGAGGGGCGGGCTCAAGGACGAGAACATCATCGTCTTCATGTACGATGACATC
GCGCACAACCCGGAGAATCCGAGGCCTGGTGTCATCATCAACCATCCCCAGGGTGGCGATGTCTAT
GCTGGGGTCCCGAAGGATTACACTGGGAAGGAGGTTAATGTCAAAAACTTGTTTGCTGTTCTGCTC
GGTAACAAAACTGCTGTCAAAGGTGGGAGTGGCAAAGTCCTGGACAGTGGCCCCAACGATCATATT
TTCATTTTTTACAGTGACCATGGGGGTCCTGGTGTCCTTGGGATGCCAACCTATCCATACCTCTAC
GGTGATGATCTTGTAGATGTTCTGAAGAAGAAGCATGCTGCTGGGACGTACAAAAGCCTGGTCTTT
TACCTTGAAGCCTGTGAATCTGGAAGCATCTTTGAGGGTCTATTGCCAAATGGCATCAATGTTTAT
GCCACCACTGCATCAAACGCTGATGAGAGCAGCTGGGGAACATACTGCCCTGGGGAGTACCCGAGC
CCACCTCCGGAGTACGACACATGCCTAGGGGACTTGTACAGCGTTGCTTGGATGGAAGACAGCGAT
GTCCACAACCTGAGAACTGAATCACTCAAGCAGCAGTACAATCTCGTCAAGGAAAGGACATCTGTG
CAGCACACATATTACTCTGGGTCACATGTGATGGAATACGGTTCTTTAGAGCTGAATGCCCATCAT
GTGTTCATGTACATGGGTTCCAATCCGGCTAACGACAATGCTACATTTGTGGAAGATAACTCGTTG
CCATCGTTCTCAAGGGCTGTTAATCAGCGGGATGCTGACCTGGTTTACTTCTGGCAGAAGTACCGC
AAATTGCCTGAGAGTTCTCCTGAGAAAAACGAAGCTCGGAAGCAATTGCTTGAAATGATGGCACAC
AGATCTCATGTTGACAACAGTGTTGAGCTGATCGGAAACCTTCTCTTTGGCTCTGAGGAAGGCCCA
AGGGTTCTAAAGGCTGTTCGTGCAACTGGCGAACCTCTTGTTGATGACTGGAGTTGTCTCAAGTCT
ATGGTACGCACTTTCGAAGCACAATGCGGCTCGCTAGCGCAGTATGGAATGAAGCATATGCGTTCC
TTTGCAAACATCTGCAATGCTGGCATCTCTGCTGAAGCGATGGCAAAGGTTGCTGCGCAGGCTTGC
ACCAGCATTCCCTCCAACCCCTGGAGTTCCACCCATAGGGGTTTTAGTGCTTAA
```

FIGURE 8 (continued)

SEQ ID NO: 182, PRT - Oryza sativa
MYDDIANNILNPRPGVIVNHPQGEDVYAGVPKDYTGDEVTAKNFYAVLLGNKTAVTGGSRKVIDSK
PNDHIFIFYSDHGGPGVLGMPNLPYLYAADFMKVLQEKHASNTYAKMVIYVEACESGSIFEGLMPE
DLNIYVTTASNAEESSWGTYCPGMEPSPPSEYITCLGDLYSVSWMEDSETHNLKEESIKKQYEVVK
KRTSDMNSYGAGSHVMEYGDRTFKDDKLYLYQGFDPANAEVKNKLSWEGPKAAVNQRDADLLFLWR
RYELLHDKSEEKLKALREISDTVMHRKLLDSSVDLVGKLLFGFGNGPSVLQAVRPSGQPLVDDWDC
LKRMVRIFESHCGPLTQYGMKHMRAFANICNNGISGASMKEASIATCSSHNSGRWSSLVQGYSA

SEQ ID NO: 183, DNA - Oryza sativa
ATGGCTGCGCGGTGCTGGGTATGGGGCTTCGTCGTCGCGCTCCTGGCTGTGGCGGCGGCGGCGGAT
GGGGAGGAGGAGGAGGGGAAGTGGGAGCCGCTGATTCGGATGCCGACGGAGGAAGGGGACGACGCT
GAGGCTGCTGCTCCCGCTCCTGCTCCTGCGGCGGCGGATTACGGGGGGACGAGGTGGGCGGTGCTC
GTCGCCGGCTCCTCCGGCTACGGGAACTACCGGCACCAGGCCGATGTGTGCCATGCGTACCAGATT
CTGCAGAAGGGAGGAGTGAAGGAGGAGAACATTGTGGTGTTTATGTATGATGACATTGCCCATAAC
ATTCTCAATCCAAGGCCTGGGACCATCATCAACCATCCTAAAGGTGGAGATGTTTATGCTGGTGTT
CCAAAGGACTACACTGGTCACCAGGTCACCACTGAGAACTTCTTTGCTGTTCTCTTGGGCAATAAA
ACCGCAGTTACTGGAGGGAGTGGGAAGGTTATAGACAGCAAACCAGAGGATCACATCTTCATCTAT
TACTCAGATCATGGGGGTCCTGGAGTTCTTGGTATGCCTAACCTGCCGTATCTTTATGCTGGTGAT
TTTATTAAAGTGTTACAAAAGAAACATGCTTCCAACAGCTACTCGAAAATGGTTATATATGTCGAA
GCATGTGAAAGTGGCAGTATCTTCGAGGGCTTAATGCCAGAAAATCTTAATATTTATGTCACAACA
GCATCCAATGCAGTTGAGAATAGTTGGGGAACATACTGCCCTGGGGAGGAACCATCACCTCCTCCT
GAATATATTACATGTCTAGGTGACATGTACAGTGTTGCTTGGATGGAGGACAGTGAGACTCATAAT
CTAAAGAAGGAAACTATCGAGGATCAGTATGAGCTGGTTAAAAAAAGAACATCAAATGCAAATAAG
TTAAATGAGGGCTCTCATGTCATGGAATATGGTGACAAGACATTCAAGGATGAGAAGCTCTTCCTC
TATCAAGGTTTTAATCCTGCAAATGGCAACATCACAAATGAATTGATTTGGCCAGTACCAAAGGCT
ACAGTCAATCAAAGAGATGCCGATCTTCTTTTCATGTGGAAGAGGTATGAGCAGTTGAATGGGGTG
TCTGAAGACAAGCTGAGGGCTCTTAGGGAGATAGAAGACACCATAGCACACAGGAAGCATCTTGAC
AGCAGTATCGATTTCATCGGGAAGCTTGTGTTTGGTTTTGAAAATGGCCTTTAGCCCTTGAGGCT
GCAAGAAGCTCTGGTCAACCATTAGTCGACAACTGGGATTGTTTGAAGAAGATGGTGCGAATTTTT
GAATCTCAATGTGGATCACTCACTCAGTATGGCATGAAATACATGAGAGCATTTGCAAACATATGC
AACAACGGTGTCTCTGAGGCCAAAATGATGGAAGCAAGTATCAACGCTTGCGGCCGTTACAACTCG
GCGAGATGGAGCCCAATGACTGAAGGAGGACACAGTGCTTGA

SEQ ID NO: 184, PRT - ORYZA SATIVA
MAARCWVWGFVVALLAVAAAADGEEEEGKWEPLIRMPTEEGDDAEAAAPAPAPAAADYGGTRWAVL
VAGSSGYGNYRHQADVCHAYQILQKGGVKEENIVVFMYDDIAHNILNPRPGTIINHPKGGDVYAGV
PKDYTGHQVTTENFFAVLLGNKTAVTGGSGKVIDSKPEDHIFIYYSDHGGPGVLGMPNLPYLYAGD
FIKVLQKKHASNSYSKMVIYVEACESGSIFEGLMPENLNIYVTTASNAVENSWGTYCPGEEPSPPP
EYITCLGDMYSVAWMEDSETHNLKKETIEDQYELVKKRTSNANKLNEGSHVMEYGDKTFKDEKLFL
YQGFNPANGNITNELIWPVPKATVNQRDADLLFMWKRYEQLNGVSEDKLRALREIEDTIAHRKHLD
SSIDFIGKLVFGFENGPLALEAARSSGQPLVDNWDCLKKMVRIFESQCGSLTQYGMKYMRAFANIC
NNGVSEAKMMEASINACGRYNSARWSPMTEGGHSA

SEQ ID NO: 185, DNA - Oryza sativa
ATGGGGCGCGGTCTCCTCTGCCTGCTGCTGCTGCAGCTCGTCGGCCTCGTCGTCGCCGGCGGTGGG
CGGTGGCGGTGGCAGGAGGAGTTCCTCCGGCTGCCGTCGTCGGATGAGACGACGAGGTGGGCGGTG
CTGATCGCGGGGTCGAATGGGTTCTATAACTACCGGCACCAGGCGGACGTGTGCCACGCGTACCAG
ATCATGAGGAAGGGAGGCGTGGAGGAGCAAAACATCGTGGTGATGATGTACGACGACATCGCCCAC FIGURE 8 (continued)

AACCCCGACAACCCCAGGCCTGGGCTCATCTTCAACCACCCTTCCGGCCCCGACGTCTACGCCGGC
GTCCCCAAGGATTACACCGGCGACGACGTCAACGTCAACAACTTCCTCGCCGTCCTCCTCGGCAAC
CGCTCCGCCCTCACCGGCTCCGGCAGCGGCAAGGTCGTCGCCAGCGGCCCCAACGACCACGTCTTC
GTCTACTACGCCGACCACGGCGGCCCCGGCGTCCTGAGCATGCCAGCCGACGGCGAGTACCTGTAC
GCCGACGACCTGGTCAAGGCGCTCAAGAAGAAGCACGCCGGCGGCGGGTACAAGAGCCTGGTCGTG
TACGTGGAGGCGTGCGAGTCCGGCAGCATCTTCGAGGGCCTCCTGCCTTCCGACATCTCCGTGTAC
GCCACCACGGCCTCCAACGCGGAGGAGAGCAGCTGGGGCACCTACTGCCCCGGCGACGACCACGAC
GCCCCGGCGGCGGAGTTCGACACCTGCCTCGGGGACCTCTACAGCGTGGCCGTGGATGGAGGACGCG
GAGGCGCACCAGGAGGGGCGCCTCGCCGAGACGCTGCGGCAGCAGTACAGGACGGTGAAGAACCGG
ACGTCCGACGAGGGCACCTACACGCTCGGCTCCCACGTCATGCAGTACGGCGACATGGCGCTCGCA
CCGCAGAGCCTGGACCTCTACTACATGGATACATCACCTGCGACGGCGAACGACCACAAATTAGCT
GCTGCTGGCGCCAAAGGCAGCCACTCCTACACTGTGTCTGTGAATCAGCGCGACGCCGATCTGCTC
TACTTGTGGCGCAAGTACCGGAGAGCCGGCGAGGGGACGGCAGAGAAGGTGGAGGCTCGGGAGCGG
CTTGTGCAGGAGATGGGACGGCGATCGCGCGTGGACAGAAGCGTGGAGATGATCGGGGGCCTCCTC
TTGGGCGGCGCCAAGCACAAGCAGCAGGTTGTGCGGGAGCGGGCTGCGCTGGTTGAGGACTGGGAG
TGCCTCAGGTCGATGGTGCGGACGTTCGAGGATCAGTGTGGGTCGCTGGGACAGTACGGGATAAAG
CACATGCGCTCCTTCGCCAACATCTGCAACGCCGGCGTCCCCCACCACGCCATGGCCAAGGCCGCC
TCCCTGGCCTGTCCATCCCCTCCTCCGTTACACTTATGA

SEQ ID NO: 186, PRT - Oryza sativa
MGRGLLCLLLLQLVGLVVAGGGRWRWQEEFLRLPSSDETTRWAVLIAGSNGFYNYRHQADVCHAYQ
IMRKGGVEEQNIVVMMYDDIAHNPDNPRPGLIFNHPSGPDVYAGVPKDYTGDDVNVNNFLAVLLGN
RSALTGSGSGKVVASGPNDHVFVYYADHGGPGVLSMPADGEYLYADDLVKALKKKHAGGGYKSLVV
YVEACESGSIFEGLLPSDISVYATTASNAEESSWGTYCPGDDHDAPAAEFDTCLGDLYSVAWMEDA
EAHQEGRLAETLRQQYRTVKNRTSDEGTYTLGSHVMQYGDMALAPQSLDLYYMDTSPATANDHKLA
AAGAKGSHSYTVSVNQRDADLLYLWRKYRRAGEGTAEKVEARERLVQEMGRRSRVDRSVEMIGGLL
LGGAKHKQQVVRERAALVEDWECLRSMVRTFEDQCGSLGQYGIKHMRSFANICNAGVPHHAMAKAA
SLACPSPPPLHL

SEQ ID NO: 187, DNA - Populus trichocarpa
ATGGAGACCCACAAGGCCTATTTTTGTCTGCTATTTTAGTGCTTGCGATGCTGTCTTTTCTACAT
GTACAGAGTGTTCAAGCCGCCCGGTTGAGCCCGGTTGAACCAAGGATTCTTATGCCAACAGGGAAA
GATGAGCCAGAAGTCGATGATGATGGTGAAGAAATTGGCTCGAGATGGGCGGTTCTTGTGGCCGGT
TCAAGTGGTTATGGAAATTACAGGCATCAGGCGGATGTCTGCCATGCATATCAACTATTAAGAAAA
GGCGGGATAAAAGAAGAGAACATGGTGGTGTTTATGTATGATGATATAGCCATGCATCATTTGAAC
CCAAGGCCTGGAGTTATCATCAACCATCCACAAGGAGATGATGTTTATGCTGGTGTGCCTAAGGAT
TACACTGGTGAACAGGTTAATACAGAGAATCTGTATGCAGTACTTCTTGGTAACAAGAGTGCTGTC
AAGGGTGGAAGTGGCAAGGTTGTGGATAGCAAGCCCAATGACAGGATCTTCTTGTACTATTCTGAT
CATGGAGGTCCTGGAGTTCTTGGAATGCCAAATATGCCTTTTCTATATGCAATGGATTTCATCGAG
GTTCTGAAGAAGAAACATGCATCTGGGAGCTACAAAGAAATGGTAATGTATATAGAAGCTTGCGAG
AGTGGGAGCATCTTCGAAGGGATCATGCCTAAGGACCTAAACATTTACGTGACGACAGCATCAAAT
GCGGAAGAGAGGGATCTGTACAGTGTTGCTTGGATGGAAGATAGTGAAACACACAATCTGAAGAAA
GAAACAATTAAGCAGCAATATCATTCGGTGAAAGAGAGGACTTCCAATTACAATGCATTCACTTCT
GGATCCCATGTGATGCAATATGGGAACGAAAGCCTCAAGGAGAGAAGCTTTTTTGTATCAAGGT
TTCGATCCAGCTAGTGTAAACTTCCCTCCAAACAATGGCCACATTGGTGCGCGTATGGATGTTGTT
AACCAGAGAGATGCAGAGCTTGTTTTCCTCTGGCAAATGTACAAAAGAGCTGAAGGTGGGTCAGAA
AAGAAGACCCAAATCCTCAATCAGATTAAAGAGACAATGAGGCATAGAACTCACTTGGACAGCAGC FIGURE 8 (continued)

```
ATGGAATTGATCGGAACACTATTATTAGGACCTAAAAAAGGTTCCACCATCCTTAAATCTGTTAGG
GAACCCGATTCGCCCCTAGTAGATGACTGGAGATGCTTAAAATCAATGGTTCGATTGTTTGAAACA
CATTGTGGATCACTGACTCAGTATGGAATGAAACACATGCGAGCATTTGCCAACATTTGCAATGGT
GGCGTCTCTCTAGCCTCCATGGAGGAAGCTTGTGTGGCCGCTTGTAGTGGCCATGATGCTGGGGAA
CTGCATCCTTCAAACCAAGGTTACAGTGCTTAA
```

SEQ ID NO: 188, PRT - Populus trichocarpa
```
METHKAYFLSAILVLAMLSFLHVQSVQAARLSPVEPRILMPTGKDEPEVDDDGEEIGSRWAVLVAG
SSGYGNYRHQADVCHAYQLLRKGGIKEENMVVFMYDDIAMHHLNPRPGVIINHPQGDDVYAGVPKD
YTGEQVNTENLYAVLLGNKSAVKGGSGKVVDSKPNDRIFLYYSDHGGPGVLGMPNMPFLYAMDFIE
VLKKKHASGSYKEMVMYIEACESGSIFEGIMPKDLNIYVTTASNAEERDLYSVAWMEDSETHNLKK
ETIKQQYHSVKERTSNYNAFTSGSHVMQYGNESLKGEKLFLYQGFDPASVNFPPNNGHIGARMDVV
NQRDAELVFLWQMYKRAEGGSEKKTQILNQIKETMRHRTHLDSSMELIGTLLLGPKKGSTILKSVR
EPDSPLVDDWRCLKSMVRLFETHCGSLTQYGMKHMRAFANICNGGVSLASMEEACVAACSGHDAGE
LHPSNQGYSA
```

SEQ ID NO: 189, DNA - Populus trichocarpa
```
ATGACGCGACTCATTGCCGGCGTAATTTTTCTTCTTATTTCTTTCTGTGGTATCGCCGTCGGTGTC
CGAGACATCGTTGGTGACGTTCTCCGGTTGCCATCGGAGGCTTCTAGGTTTTTCCGTCCCGGTAAA
TTTAATGATGATAATAGTGATGATGATTCTTCCGGAACTAGATGGGCCATCTTGCTTGCCGGATCT
AACGGTTACTGGAATTACCGGCACCAGGCAGATGTTTGTCATGCATATCAACTGCTGAGACAAGGT
GGATTGAAGGAAGAAAATATAATAGTTTTCATGTACGATGACATTGCTGATAACCCAGAGAACCCA
AGGCCTGGAGTCATCATCAACAATCCCCAAGGAGAAGATGTTTATAAAGGAGTTCCAAAGGATTAT
ACTGGTCCAGATGTCACCGTTGGAAACTTTTTCGCGGCTATCCTTGGAAACAAGACAGCTCTTACC
GGGGGCAGTGGAAAAGTTATTGATAGTGGGCCAATGACCATATTTTCATTTATTATACTGATCAT
GGAGGTCCTGGGGTGCTAGGGATGCCTACCAATCCTTACCTTTATGCGGATGATTTGATTGATGTC
TTAAAAAAGAAGCATGCATCCGGAACCTATAAAAGCTTGGTGTTTTATCTTGAAGCCTGTGAATCC
GGAAGCATCTTTGAGGGTCTTCTTCCTCAAGGTCTAAATATCTATGCAACCACAGCATCAAATGCA
GAAGAGAGCAGTTGGGGAACCTATTGTCCTGGAGAGTATCCTAGCCCTCCCCAGAATACGAAACT
TGTTTGGGTGACTTGTACAGTGTTGCTTGGATGGAGGATAGTGACATACACAATTTACGGACAGAA
ACTCTGCACCAGCAATATGAACTGGTAAAAAGGAGGACTTCCTATGACAATTCTCCCTACGGTTCC
CATGTCATGCAATATGGTGATGTTGGACTTAGCAAGGACGACCTCTTCCAGTATATGGGTACAAAC
CCTGCAAATGATAACTACACTTTCGTGGAGGAGAACTCCTTGAGGCCACATTCTAAAGTTGTTAAT
CAGCGTGATGCTGATCTCGTCCACTTCTGGACTAAGTACCGCAAGGCCCCAGAAGGCTCTTCTAGG
AAGGTTGAAGCTCAGAAGCAGTTTGTTGAAGCAATGTCACATAGAATGCATATTGACCACAGCATA
AAACTTATTGGGAAGCTCCTCTTTGGAATTGAAAAGGCCTCAGAGGCATTGAACACCGTACGTCCT
GCTGGGCAACCTCTTGTTGATGACTGGGTCTGCCTTAAGACACTGGTAAAATTTTACAGTTCTCAG
CCTCTGCTTTATCACCTCCTAACCTTATGGGATGAAACACATGCGATCTCTTGCAAACCTTTGCAA
TGCCGGAATTGTAAAGGAACAGATGGCCGAGGCATCAGCACAAGCTTGTGTAAGCTTTCCTTCTGG
TTCATGGAGCTCTCTTCACAAAGGGTTCAGCGCCTAATTGAAGCAGAATGTCCTATTTAA
```

SEQ ID NO: 190, PRT - Populus trichocarpa
```
MTRLIAGVIFLLISFCGIAVGVRDIVGDVLRLPSEASRFFRPGKFNDDNSDDDSSGTRWAILLAGS
NGYWNYRHQADVCHAYQLLRQGGLKEENIIVFMYDDIADNPENRPGVIINNPQGEDVYKGVPKDY
TGPDVTVGNFFAAILGNKTALTGGSGKVIDSGPNDHIFIYYTDHGGPGVLGMPTNPYLYADDLIDV
LKKKHASGTYKSLVFYLEACESGSIFEGLLPQGLNIYATTASNAEESSWGTYCPGEYPSPPPEYET
CLGDLYSVAWMEDSDIHNLRTETLHQQYELVKRRTSYDNSPYGSHVMQYGDVGLSKDDLFQYMGTN
```

FIGURE 8 (continued)

PANDNYTFVEENSLRPHSKVVNQRDADLVHFWTKYRKAPEGSSRKVEAQKQFVEAMSHRMHIDHSI
KLIGKLLFGIEKASEALNTVRPAGQPLVDDWVCLKTLVKFYSSQPLLYHLLTLWDETHAISCKPLQ
CRNCKGTDGRGISTSLCKLSFWFMELSSQRVQRLIEAECPI

SEQ ID NO: 191, DNA - Populus trichocarpa
ATGTTGAGTCCTGGAAGTTGGAACCTCTCTGTATATTGCATGCCCCTATATTCTAATTTCTTTCTA
GTCGTCAGAAAGCTGGTTGATTACTTGAATTGCAGTATGAGCAGCAGCTCCTATCTGTGTGGCTAT
GGCTATGGCACATTTCTTTTCCTAATCGCATTGTTAAGTTCCATAGCTCAAAGTCAGGGAGTGATC
ATCAACAGTACTAGTGCGTCAAGCTTGCCATCGAGTGTTAGAAGAGACTCCACTACCGCTGAAGGA
AAACAATGGGCCGTTTTGGTTGCCGGATCGGCTGGTTATGAAAATTACAGGCATCAGGCTGATGTA
TGCCATGCATACCAAATACTGAAGAAGGTGGGTTGAAAGATGAAAACATCATTGTTTTCATGTAT
GATGACATTGCGTTCCATGTTGATAATCCCAGGCCCGGCATCATCATCAACAAACCTTTTGGTCAT
GATGTTTATGCAGGAGTCCCCAAGGATTATACTGGAGATAACTGTACAGTGGACAACTTATTTGCT
GTACTTCTGGGAAACAAATCTGCTCTTACTGGAGGGAGTGGCAAGGTTGTGGATAGTGGTCCAAAT
GACAACATTTTCATATACTATGCTGATCATGGTGCTCCAGGTTTAGTCGGTATGCCTATTGGGAAA
GACCTGTATGCCAAAGACCTCATACAAGTGTTGAAGAAGCAGCAGGAAGCTAATTCGTATAAAAGC
ATGGTATTCTACCTTGAAGCTTGTGAGTCTGGGAGTATGTTCGAAGGTCTTCTTCCAAGTAACTGG
AGCATATATGCAATTACTGCTGCAAATGGAGAGGAGAGTAGCTATGAATATATTGCCCAGGATAC
TACCCTGCTCCTCCCCCAGAATTTCTTACTTGCTTGGGAGATGTATTTAGCATTTCTTGGATGGAG
GATAGTGATTTGCACGACATGAGCCAGGAAACTCTGCAGCAGCAATATGAAGTGGTTCGGAGAAGG
ACAGGATTTGATTATGAAGATAGGTCTCATGTCATGCAATATGGAAACATGGAGCTTAGTAAGGAG
CTGCTCTCTTCTTACTTGGGCACAAACGCTGCAAACGATAACTACGCTACCAACATTAATATCGAA
GAATACCCTTCTATGATCCCAAGAGCTTTTGACCAACGCGAAGCAACTCTTCTTCATTTCTGGCAC
AAGTATCAAGAAGCCCCCGATGGATCTGATAAGAAGGCCGAGGCTCACAAGGACCTACTTCGCATA
CATTCTCATATAAGGCATGTGGATCGTAGCCTAAGCCATATTGCTTCAACTCTGTTTGGGGATGAA
AACGCAGCAAATGCAATGAAGCATGTTAGACCTTCTGGGCAACCTCTTGTTGATGACTGGGATTGC
TTGAAGGGCCTTGTGGAAGCTTATGAGAAACAGTGTGGAGGTCTGTCATGGTATGGAAAGAAGTAC
ACGAGAGTGATAGCAAACATGTGCAATGCTGGGATAAATGTGGAGCAAATGATCGGTGCATCCACC
AGAGCATGCTCATCAAGGACCACCACCACCACTCCTACTAGAGGCTCCCTTCAAAACGAATTTGAC
AAAATAG

SEQ ID NO: 192, PRT - Populus trichocarpa
MLSPGSWNLSVYCMPLYSNFFLVVRKLVDYLNCSMSSSYLCGYGYGTFLFLIALLSSIAQSQGVI
INSTSASSLPSSVRRDSTTAEGKQWAVLVAGSAGYENYRHQADVCHAYQILKKGGLKDENIIVFMY
DDIAFHVDNPRPGIIINKPFGHDVYAGVPKDYTGDNCTVDNLFAVLLGNKSALTGGSGKVVDSGPN
DNIFIYYADHGAPGLVGMPIGKDLYAKDLIQVLKKQQEANSYKSMVFYLEACESGSMFEGLLPSNW
SIYAITAANGEESSYGIYCPGYYPAPPPEFLTCLGDVFSISWMEDSDLHDMSQETLQQQYEVVRRR
TGFDYEDRSHVMQYGNMELSKELLSSYLGTNAANDNYATNINIEEYPSMIPRAFDQREATLLHFWH
KYQEAPDGSDKKAEAHKDLLRIHSHIRHVDRSLSHIASTLFGDENAANAMKHVRPSGQPLVDDWDC
LKGLVEAYEKQCGGLSWYGKKYTRVIANMCNAGINVEQMIGASTRACSSRTTTTTPTRGSLQNEFD
K

SEQ ID NO: 193, DNA - Solanum lycopersicum
ATGGTTCACGTCGCCGGAGTTTTCATCCTCGTCGGAATCGCCGTGCTTGCCGCCGTCGAAGGACGT
AATGTTTTGAAACTTCCGTCGGAAGCTTCCAGATTCTTCGATGACGCAGATGACTCTGTTGGAACC
AGATGGGCCGTCCTTCTCGCCGGATCAAATGGTTATTGGAATTATAGACATCAGGCTGATGTATGC
CATGCGTATCAGCTATTGAGAAAAGGTGGTCTCAAAGATGAAAATATTATTGTCTTCATGTATGAT FIGURE 8 (continued)

```
GACATTGCTCACCATGAAGAGAACCCAAGACCAGGAGTTATTATTAATAGTCCTGCCGGTGAGGAT
GTTTACGAAGGAGTTCCTAAGGATTACACGGGAGATGATGTTAATGTGCACAACTTTTTAGCTGTT
CTCCTTGGTAACAAAACTGCTCTTACTGGAGGTAGCGGAAAGGTGGTGAATAGTGGTCCAAATGAT
CATATTTTCATATTCTATAGTGATCATGGTGGCCCTGGCGTGCTTGGGATGCCTACCAATCCTTAT
CTATATGCCGATGATCTAATTGCTGTGTTGAAAAAGAAGCATGCCCCTGGGACATATAAAAGCTTG
GTATTGTACATTGAAGCTTGCGAGTCTGGAAGTATATTTGAGGGACTTCTTCCTAATGGTCTAAAT
ATTTATGCCACAACAGCTTCAAATGCTGAAGAAAGCAGCTGGGGAACCTATTGTCCTGGAGAATAT
CCTAGTCCTCCTCCTGAATATGAGACTTGCTTGGGTGATTTGTATGCTGTTTCCTGGATGGAGGAC
AGTGAAATGCACAACTTGCGGACTGAAAATTTGAGGCAGCAGTATCACTTGGTCAAAAAGAGAACT
GCAAATGGAAATACTGCCTATGGTTCCCATGTCATGCAATTTGGTGATCTACAACTGAGTATGGAG
TCTCTATTCAGGTTTATGGGTACAAATCCTGCAAATGATAACTACACTTATGTAGATGACAATTCC
TTGTTGGCATCATCAAAGGCTGTCAACCAGCGTGATGCAGATCTTTTACATTTCTGGGACAAGTTC
CGCAAGGCTCCTGAAGGCTCTGCTCGGAAAGTTGAAGCTCAGAAACAATTCACTGAAGCTATGTCA
CACAGAATGCACCTAGATGAACGCATTGCCCTTGTTGGTAAGCTTCTGTTTGGAATTCAAAAAGGT
CCTGAGGTGCTGAAGCATGTTCGATCTGCGGGTCAGCCTCTTGTTGATGATTGGGCCTGCCTTAAA
TCTTTTGTAAGAACATTTGAGTCGCACTGCGGATCGTTATCCCAATATGGAATGAAACACATGCGT
TCCATTGCCAATATCTGCAATGCTGGAATTCAGATGGAGCAGATGGTGGAGGCATCAGCACAAGCT
TGTCCTAGCATCCCTTCCAATATTTGGAGTTCCCTCCACAGGGGCTTTAGTGCGTAA
```

SEQ ID NO: 194, PRT - Solanum lycopersicum
```
MVHVAGVFILVGIAVLAAVEGRNVLKLPSEASRFFDDADDSVGTRWAVLLAGSNGYWNYRHQADVC
HAYQLLRKGGLKDENIIVFMYDDIAHHEENPRPGVIINSPAGEDVYEGVPKDYTGDDVNVHNFLAV
LLGNKTALTGGSGKVVNSGPNDHIFIFYSDHGGPGVLGMPTNPYLYADDLIAVLKKKHAPGTYKSL
VLYIEACESGSIFEGLLPNGLNIYATTASNAEESSWGTYCPGEYPSPPPEYETCLGDLYAVSWMED
SEMHNLRTENLRQQYHLVKKRTANGNTAYGSHVMQFGDLQLSMESLFRFMGTNPANDNYTYVDDNS
LLASSKAVNQRDADLLHFWDKFRKAPEGSARKVEAQKQFTEAMSHRMHLDERIALVGKLLFGIQKG
PEVLKHVRSAGQPLVDDWACLKSFVRTFESHCGSLSQYGMKHMRSIANICNAGIQMEQMVEASAQA
CPSIPSNIWSSLHRGFSA
```

SEQ ID NO: 195, DNA - Nicotiana tabacum
```
ATGATTCGTCACATTGCCGGTACTCTGTTCATAATTGGACTCGCACTTAACGTCGCCGTTTCAGAG
AGCCGTAATGTTTTGAAACTTCCGTCAGAAGTTTCTAGATTCTTCGGTGCCGATAAGAGTAATGTC
GGCGATGATCATGATGACGACTCCGTCGGTACCAGATGGGCTATCCTGCTAGCCGGATCTAACGGT
TATTGGAATTACCGTCACCAGGCTGATATATGCCACGCATATCAACTGTTGAAGAAGGGTGGTCTC
AAAGATGAGAACATTGTTGTGTTTATGTACGATGACATTGCTAACAATGAAGAGAATCCAAGACCA
GGAGTTATCATTAATAGCCCTCATGGTGAGGATGTTACAAAGGAGTTCCTAAGGATTACACTGGG
GATGATGTTACTGTTAACAACTTTTTGCTGCTCTCCTTGGGAACAAAACTGCTCTTAGTGGAGGC
AGCGGAAAGGTGGTGAATAGTGGTCCGAATGATCATATCCTCATCTTCTATAGTGATCATGGCGGC
CCTGGAGTGCTTGGGATGCCTACCGATCCTTACCTCTATGCAAACGATCTGATTGACGTGTTGAAG
AAGAAGCATGCTTCCGGAACATATAAAGCTTGGTATTTTACCTTGAAGCTTGTGAGTCTGGTAGT
ATATTTGAGGGTCTTCTTCCTGAAGGTTTAAATATCTATGCCACAACAGCATCAAATGCTGAAGAG
AGTAGCTGGGGAACCTATTGTCCTGGAGAGTATCCCAGTCCTCCTATTGAATATGAGACTTGCCTG
GGTGACTTGTACAGTATTTCCTGGATGGAGGACAGTGAATTACACAACCTGCGGACTGAAAGTCTG
AAGCAGCAGTATCACCTGGTCAGAGAGAACTGCTACTGGGAATCCTGTTTATGGTTCACATGTC
ATGCAATATGGTGATCTACATCTCAGCAAGGATGCTCTATACTTATATGGGTACAAATCCTGCT
AATGATAATTATACTTTTATGGATGACAATTCCTTGCGAGTATCAAAGGCCGTTAACCAGCGTGAT
GCAGATCTTCTGCATTTTTGGTACAAGTTCCGCAAGGCTCCTGAGGGCTCTGTGAGGAAAATTGAG
```

FIGURE 8 (continued)

```
GCTCAGAAACAGTTAAATGAAGCAATATCACATAGAGTGCACTTGGACAACAGCATAGCCCTTGTC
GGTAAACTTCTATTTGGAATTAAAAAAGGTCCAGAGGTGCTAAGTAGTGTCCGCCCTGCTGGTCAG
CCTCTTGTTGATGACTGGGACTGCCTTAAATCCTTTGTAAGAACATTTGAGACACATTGTGGATCG
TTATCCCAGTATGGAATGAAACATATGCGCTCCATTGCTAACATATGCAACGTTGGAATTAAGATG
GCGCAGATGGTGGAGGCATCAGCACAAGCTTGTCCCAGCTTTGCATCCAATACTTGGAGTTCCCTC
CAGAGGGGTTTTAGTGCATGA
```

SEQ ID NO: 196, PRT - Nicotiana tabacum
```
MIRHIAGTLFIIGLALNVAVSESRNVLKLPSEVSRFFGADKSNVGDDHDDDSVGTRWAILLAGSNG
YWNYRHQADICHAYQLLKKGGLKDENIVVFMYDDIANNEENPRPGVIINSPHGEDVYKGVPKDYTG
DDVTVNNFFAALLGNKTALSGGSGKVVNSGPNDHILIFYSDHGGPGVLGMPTDPYLYANDLIDVLK
KKHASGTYKSLVFYLEACESGSIFEGLLPEGLNIYATTASNAEESSWGTYCPGEYPSPPIEYETCL
GDLYSISWMEDSELHNLRTESLKQQYHLVRERTATGNPVYGSHVMQYGDLHLSKDALYLYMGTNPA
NDNYTFMDDNSLRVSKAVNQRDADLLHFWYKFRKAPEGSVRKIEAQKQLNEAISHRVHLDNSIALV
GKLLFGIKKGPEVLSSVRPAGQPLVDDWDCLKSFVRTFETHCGSLSQYGMKHMRSIANICNVGIKM
AQMVEASAQACPSFASNTWSSLQRGFSA
```

SEQ ID NO: 197, DNA - Saccharum officinarum
```
ATGGTGACCGCTCGCCTCCGCCTCGCGCTGCTACTACTCTCCGTGTTCCTCTGCTCCGCGTGGGCG
CGCCCACGCCTCGAGCCGACCATCCGCCTGCCGTCCGAGCGCGCCGCGGCGGCGGCCGGCGACGAA
ACGGACGACGCCGTCGGGACACGGTGGGCCGTGCTCGTCGCCGGCTCCAGCGGCTACTACAACTAC
CGCCACCAGGCAGACATCTGCCATGCGTACCAGATTATGAAGAAGGGAGGACTCAAGGACGAGAAC
ATAATTGTCTTCATGTACGATGACATCGCGCATAGCGCAGAGAATCCGAGGCCCGGTGTCGTCATC
AACCATCCCCAGGGTGGCGATGTCTATGCTGGGGTTCCAAAGGATTACACTGGGCGACAGGTCAGT
GTCAACAATTTCTTCGCTGTTCTGCTTGGCAACAAAACTGCTCTGACAGGTGGGAGCGGCAAGGTT
GTGGACAGTGGCCCCAATGATCATATCTTTGTTTTCTACAGTGACCATGGAGGTCCTGGTGTCCTT
GGAATGCCTACGTATCCATATCTCTACGGTGATGACCTCGTAGATGTCCTGAAGAAGAAGCATGCT
GCTGGGTCCTACAAAAGCCTGGTCTTTTACCTTGAAGCATGCGAATCTGGGAGCATCTTTGAGGGC
CTCCTGCCAGATGACATCAATGTGTATGCGACCACCGCGTCAAATGCAGAGGAGAGCAGCTGGGGG
ACGTACTGCCCTGGCGAGTTCCCAAGCCCTCCACCGGAGTATGACACTTGCTTGGGAGACCTGTAT
AGTGTTTCTTGGATGGAAGACAGTGATTTCCACAATCTGCGAACTGAATCTCTCAAGCAGCAGTAC
AAGTTGGTCAAGGATAGGACAGCGGCTCAGGATACATTCAGCTATGGTTCCCATGTGATGCAATAT
GGTTCATTGGAGTTGAATGTTCAGAAATTGTTTTCGTACATTGGCACAAACCCTGCTAACGATGGC
AACACATTTGTAGAAGATAACTCATTGCCATCATTTTCAAAAGCTGTTAATCAGCGTGATGCTGAT
CTTGTCTACTTCTGGCAGAAGTACCGGAAATTGGCTGATGGCTCATCTAAGAAAAATGAAGCTCGG
AAGGAATTGCTTGAAGTGATGTCCCACCGGTCTCATGTTGACAACAGTGTTGAACTCATTGGAAGC
CTTCTCTTTGGCTCTGAGGACGGTCCAAGGGTTCTGAAAGCCGTCCGTGCAGCTGGTGAACCTCTG
GTTGATGATTGGAGTTGCCTCAAGTCCATGGTTCGTACTTTTGAGGCGCAATGTGGGTCGTTGGCG
CAGTATGGGATGAAGCACATGAGAACCTTCGCAAACATCTGCAACGCTGGCATCCTTCCTGAAGCA
GTGTCAAAGGTTGCCGCTCAGGCTTGCACCAGCATTCCTTCCAACCCCTGGAGCTCTATCGACAAG
GGTTTTAGCGCCTAA
```

SEQ ID NO: 198, PRT - Saccharum officinarum
```
MVTARLRLALLLLSVFLCSAWARPRLEPTIRLPSERAAAAAGDETDDAVGTRWAVLVAGSSGYYNY
RHQADICHAYQIMKKGGLKDENIIVFMYDDIAHSAENPRPGVVINHPQGGDVYAGVPKDYTGRQVS
VNNFFAVLLGNKTALTGGSGKVVDSGPNDHIFVFYSDHGGPGVLGMPTYPYLGDDLVDVLKKKHA
AGSYKSLVFYLEACESGSIFEGLLPDDINVYATTASNAEESSWGTYCPGEFPSPPPEYDTCLGDLY
```

FIGURE 8 (continued)

SVSWMEDSDFHNLRTESLKQQYKLVKDRTAAQDTFSYGSHVMQYGSLELNVQKLFSYIGTNPANDG
NTFVEDNSLPSFSKAVNQRDADLVYFWQKYRKLADGSSKKNEARKELLEVMSHRSHVDNSVELIGS
LLFGSEDGPRVLKAVRAAGEPLVDDWSCLKSMVRTFEAQCGSLAQYGMKHMRTFANICNAGILPEA
VSKVAAQACTSIPSNPWSSIDKGFSA

SEQ ID NO: 199, DNA - Zea mays
ATGGTGGCCGCTCGCCTCCGCCTCGCGCTGCTACTCTCCGTCTGCCTCTGCTCCGCGTGGGCGCGC
CCACGCCTCGAGACGGCCATCCGCCTGCCGTCGCAGCGCGCGGCGGCGGCCGACGAAACGGACGAC
GGCGCCGTCGGGACCCGCTGGGCTGTGCTCATCGCAGGCTCCAGCGGCTACTACAACTACCGCCAC
CAGGCGGACATCTGCCATGCATACCAGATCATGAAGAAGGGCGGACTCAAGGATGAGAACATCATT
GTCTTCATGTACGATGACATCGCGCATAGCCCGGAGAATCCGAGGCCTGGTGTCATCATCAACCAT
CCCCAGGGTGGCGACGTCTATGCTGGGGTGCCAAAGGATTACACGGGGCGAGATGTCAACGTCGAC
AATTTCTTCGCTGTTCTGCTTGGCAACAAAACTGCTCTCAGGGGTGGGAGCGGCAAGGTTGTGGAC
AGTGGCCCCGATGATCATATCTTTGTTTTCTACAGTGACCATGGGGGTCCTGGTGTCCTTGGAATG
CCTACGTATCCATATCTCTATGGTGATGACCTCGTAGATGTCCTGAAGAAGAAGCATGCTGCCGGG
ACCTACAAAAGCCTGGTCTTTTACCTTGAAGCATGCGAATCTGGGAGCATCTTTGAGGGCCTCCTG
CCGAATGACATCAATGTGTATGCGACCACCGCGTCAAATGCAGAGGAGAGCAGCTGGGGGACATAC
TGCCCTGGCGAGTTCCCGAGCCCTCCACCGGAGTATGACACCTGCTTGGGTGACCTGTACAGTGTT
GCTTGGATGGAAGACAGTGATTTCCACAATCTGCGAACTGAATCTCTCAAGCAGCAGTACAAGTTG
GTCAAGGATAGGACAGCGGTTCATGACACGTTCAGCTATGGTTCCCATGTGATGCAATATGGCGCA
CTGGAGTTGAATGTTCAGCATTTGTTTTCGTACATTGGCACAGACCCTGCTAACGATGGCAACACG
TTTATAGAAGATAACTCACTGCCATCGTTCTCAAAAGCCGTCAATCAGCGCGACGCTGACCTTGTC
TACTTCTGGCAGAAGTACCGGAAATTTGCTGATAGCCCGCCTGCAAAAGCGAGGCTCGGAAGGAA
CTGCTTGAAGTGATGGCCCACAGGTCTCATGTTGACAGCAGCGTTGAGCTCATCGGAAGCCTTCTC
TTTGGCTCTGAGGACGGTCCAAGGGTTCTGAAAGCCGTCCGTGCACCTGGTGAACCTCTGGTTGAT
GATTGGAGCTGCCTCAAGTCCATAGTTCGCACTTTTGAGGCGCGATGCGGGTCCTTGGCGCAGTAT
GGGATGAAGCACATGCGATCCTTCGCGAACATGTGCAACGCTGGCATCCTTCCTGAAGCAGTGTCG
AAGGTGGCCGCTCAGGCCTGCAGCAGCATTCCGTCCAACCCCTGGAGCTCTATCCACAAGGGTTTT
AGCGCTTAA

SEQ ID NO: 200, PRT - Zea mays
MVAARLRLALLLSVCLCSAWARPRLETAIRLPSQRAAAADETDDGAVGTRWAVLIAGSSGYYNYRH
QADICHAYQIMKKGGLKDENIIVFMYDDIAHSPENPRPGVIINHPQGGDVYAGVPKDYTGRDVNVD
NFFAVLLGNKTALRGGSGKVVDSGPDDHIFVFYSDHGGPGVLGMPTYPYLYGDDLVDVLKKKHAAG
TYKSLVFYLEACESGSIFEGLLPNDINVYATTASNAEESSWGTYCPGEFPSPPPEYDTCLGDLYSV
AWMEDSDFHNLRTESLKQQYKLVKDRTAVHDTFSYGSHVMQYGALELNVQHLFSYIGTDPANDGNT
FIEDNSLPSFSKAVNQRDADLVYFWQKYRKFADSPPAKSEARKELLEVMAHRSHVDSSVELIGSLL
FGSEDGPRVLKAVRAPGEPLVDDWSCLKSIVRTFEARCGSLAQYGMKHMRSFANMCNAGILPEAVS
KVAAQACSSIPSNPWSSIHKGFSA

SEQ ID NO: 201, DNA - Zea mays
ATGGTGGCCGATCGCCTCCGCCTCGCGCTGCTGCTCTCCGCGTGCCTCTGCTCCGCGTGGGCGCGC
CCACGCCTCGAGCCGACCATCCGCCTGCCGTCCGACCGCGCGGCGGCCGACGACGCCGTCGGGACC
CGGTGGGCCGTGCTCATCGCCGGCTCCAACGGCTACTACAACTACCGCCACCAGGCGGACATCTGC
CATGCATACCAGATCATGAAGAAGGGCGGACTTAAGGACGAGAACATCGTTGTCTTCATGTACGAT
GACATCGCGCATAGCCCGGAAAATCCGAGGCCTGGTGTCATCATAAATCATCCCCAGGGTGGCGAC
GTCTATGCTGGGGTGCCAAAGGATTACACTGGGCGAGATGTCAACGTCGACAATTTCTTCGCTGTT FIGURE 8 (continued)

CTGCTTGGCAACAAAACTGCTCTCAGGGGTGGGAGCGGCAAGGTTGTGGACAGTGGCCCCAATGAT
CATATATCTGTTTTCTACAGTGACCATGGGGGTCCTGGCGTCCTTGGAATGCCTACGTATCCATAT
CTCTATGGTGATGACCTCGTAGATGTCCTGAAGAAGAAGCATGCTGCCGGGACCTACAAAAGCCTG
GTCTTTTACCTTGAAGCATGCGAATCTGGGAGCATCTTTGAGGGCCTCCTGCCGAATGACATAAAT
GTGTATGCGACCACCGCGTCAAATGCAGAGGAGAGTAGCTGGGGGACGTACTGCCCTGGCGAGTTC
CCGAGCCCTCCGCCGGAGTATGACACTTGCTTGGGAGACCTGTATAGTGTTGCTTGGATGGAAGAC
AGTGATTTCCACAATCTGCGAACTGAATCTCTCAAGCAGCAATACAACTTGGTCAAGGATAGGACA
GCGGTTCAGGATACATTCAGCTATGGCTCCCATGTGATGCAATATGGTTCATTGGGGTTGAATGTT
AAGCATCTGTTTTCGTACATTGGCACAAACCCTGCTAACGATGACAACACGTTCATAGAAGACAAC
TCGTTGCCATCATTCTCAAAGGCTGTTAATCAGCGCGACGCTGACCTTGTCTACTTCTGGCAGAAG
TACCGGAAATTGGCAGACAGCTCACCTGAGAAAAATGAAGCTCGGAGGGAGTTGCTTGAAGTGATG
GCCCACAGGTCTCATGTTGACAGCAGCGTTGAGCTCATTGGAAGCCTTCTCTTTGGCTCTGAGGAC
GGTCCAAGGGTTCTGAAAGCCGTCCGTGCAGCTGGTGAGCCTCTGGTCGATGATTGGAGCTGTCTC
AAGTCCACGGTTCGTACTTTTGAGGCGCAATGTGGGTCGTTGGCGCAGTATGGGATGAAGCACATG
CGGTCCTTCGCAAACATCTGCAACGCTGGCATCCTTCCTGAAGCAGTGTCGAAGGTCGCTGCTCAG
GCTTGCACCAGCATTCCTTCCAACCCCTGGAGTTCTATCCACAAGGGTTTTAGCGCCTAA

SEQ ID NO: 202, PRT - Zea mays
MVADRLRLALLLSACLCSAWARPRLEPTIRLPSDRAAADDAVGTRWAVLIAGSNGYYNYRHQADIC
HAYQIMKKGGLKDENIVVFMYDDIAHSPENPRPGVIINHPQGGDVYAGVPKDYTGRDVNVDNFFAV
LLGNKTALRGGSGKVVDSGPNDHISVFYSDHGGPGVLGMPTYPYLYGDDLVDVLKKKHAAGTYKSL
VFYLEACESGSIFEGLLPNDINVYATTASNAEESSWGTYCPGEFPSPPPEYDTCLGDLYSVAWMED
SDFHNLRTESLKQQYNLVKDRTAVQDTFSYGSHVMQYGSLGLNVKHLFSYIGTNPANDDNTFIEDN
SLPSFSKAVNQRDADLVYFWQKYRKLADSSPEKNEARRELLEVMAHRSHVDSSVELIGSLLFGSED
GPRVLKAVRAAGEPLVDDWSCLKSTVRTFEAQCGSLAQYGMKHMRSFANICNAGILPEAVSKVAAQ
ACTSIPSNPWSSIHKGFSA

SEQ ID NO: 203, DNA - Zea mays
ATGGCTGTGCGGTGGTGCCTCCTCCTGCTCGTGTTAGTGTTGGCTGCGGCCGCGGCTTGCGCGGAG
AAGGGGGAGTGGGACCCGGTGATTCGGATGCCTGGGGAGAAGGAGCCTGCAGGGTCGCACTCGCAC
AGCGGCGAGGGATTCGATGGGGAGGTGGATGACGCCGTCGGGACGAGGTGGGCAGTGCTCGTTGCC
GGGTCCTCCGGCTACGGCAACTACAGGCACCAGGCTGATATATGTCATGCGTACCAGATACTGCAA
AAAGGAGGCATAAAAGAGGAGAACATTGTGGTGTTTATGTATGATGACATTGCCAATAGCGCACTC
AACCCAAGGCAGGGGGTTATCATCAACCACCCAGAGGGCGAAGATGTTTATGCTGGTGTTCCAAAG
GACTACACTGGGGACCAAGTCACTACTAAGAACTTCTATGCAGTTCTCTTGGGCAACAAAACTGCA
GTCACTGGAGGCAGCAGGAAGGTCATCAATAGCAAACCAGATGACCATATTTTTATCTATTACTCA
GATCACGGGGGCCCTGGTGTTCTTGGTATGCCCAATCTACCATATCTTTATGCTGGTGACTTCATG
AAGGTGTTAAGAGAAAAACATGCTTCAAACAGCTATGCCAAAATGGTTATATATATTGAAGCATGT
GAAAGTGGCAGTATATTTGAGGGATTAATGCCAGAAGACCTTAATATTTATGTCACGACGGCATCC
AATGCAGAAGAAAGTAGCTGGGGTACATACTGTCCAGGAATGGAACCACCGCCTCCTTCTGAGTAC
ATTACCTGCCTAGGTGATCTATATAGTGTCTCTTGGATGGAAGACAGTGAGACTAACAATCTGAAG
GAGGAAACAGTAAAGGAACAATATGAAGTGGTGAAGAAGCGTACTTCAGACTTCAATAGCTATGGT
GCAGGCTCTCACGTCATGGAATATGGTGACAAGACCTTCAAGGAAGAGAAGCTTTACCTTTATCAA
GGTTTTGATCCTGCAAATGCCAATGTCACAAATAAGCTGCTTTGGTCAGGCCAAGAGGCTGTGGTC
AACCAAAGGGATGCAGATATTCTCTTCCTATGGAAGAGGTATGAGCTCTTACATGAAGAGTCTGAA
GAGAAGCAGGAAGTTCTGAGGGAGATCACCGGAACAGTAAGGCATAGGAAGCATCTGGACAACAGC
ATCAACTTCATCGGAAAGCTTCTCTTCGGGGCTGAGAAAGGGCCTTCCACACTTGAGGCCGTCAGA

```
CCTCCCGGCCAGCCACTCGTCGATGATTGGGACTGCTTGAAGCAAATGGTACGGATCTTCGAATCC
CATTGCGGATCGCTCACTCAGTACGGTATGAGGCATATGAGGGCGTTCGCAAATATATGCAACAGT
GGCACGCCTGGCGCTTCGATGAAGCGAGCGAGCATGGGTGCTTGTGGCGGCTACAACTCGGCGAGA
TGGAGCCCGTTGGCTCAGGGCTACAGCGCTTGA
```

SEQ ID NO: 204, PRT - Zea mays
```
MAVRWCLLLLVLVLAAAAACAEKGEWDPVIRMPGEKEPAGSHSHSGEGFDGEVDDAVGTRWAVLVA
GSSGYGNYRHQADICHAYQILQKGGIKEENIVVFMYDDIANSALNPRQGVIINHPEGEDVYAGVPK
DYTGDQVTTKNFYAVLLGNKTAVTGGSRKVINSKPDDHIFIYYSDHGGPGVLGMPNLPYLYAGDFM
KVLREKHASNSYAKMVIYIEACESGSIFEGLMPEDLNIYVTTASNAEESSWGTYCPGMEPPPPSEY
ITCLGDLYSVSWMEDSETNNLKEETVKEQYEVVKKRTSDFNSYGAGSHVMEYGDKTFKEEKLYLYQ
GFDPANANVTNKLLWSGQEAVVNQRDADILFLWKRYELLHEKSEEKQEVLREITGTVRHRKHLDNS
INFIGKLLFGAEKGPSTLEAVRPPGQPLVDDWDCLKQMVRIFESHCGSLTQYGMRHMRAFANICNS
GTPGASMKRASMGACGGYNSARWSPLAQGYSA
```

SEQ ID NO: 205, DNA - Oryza sativa - wsi18 promoter
```
GCTTGAGTCATAGGGAGAAAACAAATCGATCATATTTGACTCTTTTCCCTCCATCTCTCTTACCGG
CAAAAAAAGTAGTACTGGTTTATATGTAAAGTAAGATTCTTTAATTATGTGAGATCCGGCTTAATG
CTTTTCTTTTGTCACATATACTGCATTGCAACAATTGCCATATATTCACTTCTGCCATCCCATTAT
ATAGCAACTCAAGAATGGATTGATATATCCCCTATTACTAATCTAGACATGTTAAGGCTGAGTTGG
GCAGTCCATCTTCCCAACCCACCACCTTCGTTTTTCGCGCACATACTTTTCAAACTACTAAATGGT
GTGTTTTTAAAAATATTTTCAATACAAAAGTTGCTTTAAAAAATTATATTGATCCATTTTTTTAA
AAAAAATAGCTAATACTTAATTAATCACGTGTTAAAAGACCGCTCCGTTTGCGTGCAGGAGGGAT
AGGTTCACATCCTGCATTACCGAACACAGCCTAAATCTTGTTGTCTAGATTCGTAGTACTGGATAT
ATTAAATCATGTTCTAAGTTACTATATACTGAGATGAATAGAATAAGTAAAATTAGACCCACCTTA
AGTCTTGATGAAGTTACTACTAGCTGCGTTTGGGAGGACTTCCCAAAAAAAAAAGTATTAGCCATT
AGCACGTGATTAATTAAGTACTAGTTTAAAAAACTTAAAAAATAAATTAATATGATTCTCTTAAGT
AACTCTCCTATAGAAAACTTTTACAAAATTACACCGTTTAATAGTTTGGAAAATATGTCAGTAAAA
ATAAGAGAGTAGAAGTTATGAAAGTTAGAAAAGAATTGTTTTAGTAGTATACAGTTATAAACTA
TTCCCTCTGTTCTAAAACATAAGGGATTATGGATGGATTCGACATGTACCAGTACCATGAATCGAA
TCCAGACAAGTTTTTTATGCATATTTATTCTACTATAATATATCACATCTGCTCTAAATATCTTAT
ATTTCGAGGTGGAGACTGTCGCTATGTTTTTCTGCCCGTTGCTAAGCACACGCCACCCCCGATGCG
GGGACGCCTCTGGCCTTCTTGCCACGATAATTGAATGGAACTTCCACATTCAGATTCGATAGGTGA
CCGTCGACTCCAAGTGCTTTGCACAAAACAACTCCGGCCTCCCGGCCACCAGTCACACGACTCACG
GCACTACCACCCCTGACTCCCTGAGGCGGACCTGCCACTGTTCTGCATGCAAGCTATCTAAAATT
CTGAAGCAAAGAAAGCACAGCACATGCTCCGGGACACGCGCCACCCGGCGGAAAAGGGCTCGGTGT
GGCGATCTCACAGCCGCATATCGCATTTCACAAGCCGCCCATCTCCACCGGCTTCACGAGGCTCAT
CGCGGCACGACCGCGCACGGAACGCACGCGGCCGACCCGCGCGCCTCGATGCGCGAGCCCATCCGC
CGCGTCCTCCCTTTGCCTTTGCCGCTATCCTCTCGGTCGTATCCCGTTTCTCTGTCTTTTGCTCCC
CGGCGCGCGCCAGTTCGGAGTACCAGCGAAACCCGGACACCTGGTACACCTCCGCCGGCCACAACG
CGTGTCCCCCTACGTGGCCGCGCAGCACATGCCCATGCGCGACACGTGCACCTCCTCATCCAAAC
TCTCAAGTCTCAACGGTCCTATAAATGCACGGATAGCCTCAAGCTGCTCGTCACAAGGCAAGAGGC
AAGAGGCAAGAGCATCCGTATTAACCAGCCTTTTGAGACTTGAGAGTGTGTGTGACTCGATCCAGC
GTAGTTTCAGTTCGTGTGTTGGTGAGTGATTCCAGCCAAGTTTGCG
```

SEQ ID NO: 206, DNA - Articial sequence - forward primer
```
GGGGACAAGTTTGTACAAAAAAGCAGGCTTAAACAATGGCCACAACGATGACAC
```

SEQ ID NO: 207, DNA - Articial sequence - reverse primer
GGGGACCACTTTGTACAAGAAAGCTGGGTCGGTTTAGGGTTTCTATGCAC

SEQ ID NO: 208, PRT - Arabidopsis thaliana peptidase domain of SEQ ID NO: 2
SNSGTRWAVLVAGSSGYWNYRHQADICHAYQLLRKGGLKEENIVVFMYDDIANNYENPRPGTIINS
PHGKDVYQGVPKDYTGDDVNVDNLFAVILGDKTAVKGGSGKVVDSGPNDHIFIFYSDHGGPGVLGM
PTSPYLYANDLNDVLKKKHALGTYKSLVFYLEACESGSIFEGLLPEGLNIYATTASNAEESSWGTY
CPGEEPSPPPEYETCLGDLYSVAWMEDSGMHNLQTETLHQQYELVKRRTAPVGYSYGSHVMQYGDV
GISKDNLDLYMGTNPANDNFTFADANSLKPPSRVTNQRDADLVHFWEKYRKAPEGSARKTEAQKQV
LEAMSHRLHIDNSVILVGKILFGISRGPEVLNKVRSAGQPLVDDWNCLKNQVRAFERHCGSLSQYG
IKHMRSFANICNAGIQMEQMEEAASQACT

SEQ ID NO: 209, PRT - artificial sequence - motif caspases
E(A/G)CES

FIGURE 8 (continued)

☐ Motif 2

▨ Motif 3

▨ Motif 1

```
                        1                                                  50
SEQ_ID_NO:16    (1)  --------------------------------------------------
SEQ_ID_NO:2     (1)  --------------------------------MLLPPHPGRTLPAYHGD
SEQ_ID_NO:22    (1)  MAICMSNFYVSIYLVYCEPFNLKHLVFVLIHYYAIVSWVSGRTLPAYHGD
SEQ_ID_NO:26    (1)  --------------------------------------------------
SEQ_ID_NO:28    (1)  ---------------------MAMSGTFHLTSDYVPGYTLSDSRCFFNSAV
SEQ_ID_NO:4     (1)  ---------------------MSQTLHAFVAKNLGCGMAYGKCLPCSGVS
SEQ_ID_NO:6     (1)  --------------------------------------------------
SEQ_ID_NO:8     (1)  --------------------------------------------------
SEQ_ID_NO:20    (1)  --------------------------------------------------
   Consensus    (1)

51                                                100
SEQ_ID_NO:16    (1)  --------------------------------------------------
SEQ_ID_NO:2    (18)  NRFLLGACFLSKLPMLRPMKLSLVCSANPNNHRSRSSDITRHQKGGSARR
SEQ_ID_NO:22   (51)  NRFLLGACFLSKLPMLRPMKLSLVCSANPNNHRSRSSDITRHQKGGSARR
SEQ_ID_NO:26    (1)  --------------------------------------------------
SEQ_ID_NO:28   (31)  SRRTLAILPCSSCLDHKNGRLKSVPNRSSFVCRASSGGYRRNPDFSRLNK
SEQ_ID_NO:4    (30)  GRTAAVYSYSSLGHRRIHSHVQVRGLKCGFRGASFVCEAKRNPDFSRQNK
SEQ_ID_NO:6     (1)  --------------------------------------------------
SEQ_ID_NO:8     (1)  --------------------------------------------------
SEQ_ID_NO:20    (1)  --------------------------------------------------
   Consensus   (51)

101                                               150
SEQ_ID_NO:16    (1)  --------------------------------------------------
SEQ_ID_NO:2    (68)  KSKP---YQEKDDSENIDEFDTDIMSSKNGPPISLSNSRPQATSVPGER
SEQ_ID_NO:22  (101)  KSKP---YQEKDDSENIDEFDTDIMSSKNGPPISLSNSRPQATSVPGER
SEQ_ID_NO:26    (1)  ---------------------MDFMSKNGSLLSPTNTRYQATSSQR
SEQ_ID_NO:28   (81)  HGYRGN-NRQSGGREDFDIENSDMLSSRNGPLFNLSSPKFQATSSPGPR
SEQ_ID_NO:4    (80)  HGSSRSRNRNSDGRDSFESFDDDMFSLKNGPPVSLTSGKFQATSAPGPR
SEQ_ID_NO:6     (1)  --------------------------------------------------
SEQ_ID_NO:8     (1)  --------------------------------------------------
SEQ_ID_NO:20    (1)  --------------------------------------------------
   Consensus  (101)                           KNG    SS  R QATS   G R 151                                               200
SEQ_ID_NO:16    (1)  --------------------------------------------------
SEQ_ID_NO:2   (115)  EKEIVELFKRVQAQLRANKGEEKKPEQAKAQG---ERGSVDSLLNLLR
SEQ_ID_NO:22  (148)  EKEIVELFKRVQAQLRANKGEEKKPEQAKAQG---ERGSVDSLLNLLR
SEQ_ID_NO:26   (29)  EKEIVELFRKVQAQLREKAAIEEKK-IEAACQEQS-KKGTVDSVLKLLR
SEQ_ID_NO:28  (130)  EKEIVELFRKVQAQLRAKAAKKEKKIEEASKQGKSSETVDSILKLLR
SEQ_ID_NO:4   (130)  EKEIVELFRKVQARLREAASKEKK--VEASRAQSKENSTVDSLKLLR
SEQ_ID_NO:6     (1)  --------------------------------------------------
SEQ_ID_NO:8     (1)  -----------------MEDKAQEEEEEASKGRGKESETVDSLLKLLR
SEQ_ID_NO:20    (1)  --------------------------------------------------
   Consensus  (151)  EKEIVELFRKVQA LR RA  K E K     S G   E  TVDSLL LLR
```

FIGURE 10 B

```
                        201                                              250
SEQ_ID_NO:16      (1)   --------------------------------------------------
SEQ_ID_NO:2     (162)   KHSVDQRKKS--GDEKEQSVLQTKRSNESGNKQN---SSIFIKNDTQEEQ
SEQ_ID_NO:22    (195)   KHSVDQRKKS--GDEKEQSVLQTKRSNESGNKQN---SSIFIKNDTQEEQ
SEQ_ID_NO:26     (77)   RHSGDQKTTT--SPGEEFSVLQVERSNTFEDEQNI-NPFGPSDSKSQESD
SEQ_ID_NO:28    (180)   KHSGEQSKRQ--VSKFSSQGE--VQGDTVDKQDR---TGNLVTSGNKDNN
SEQ_ID_NO:4     (178)   KHSVEQVKRSSGGRGKDFSSLGLQESHQYNGGRNSKISDLDSSPKDEPQE
SEQ_ID_NO:6       (1)   ----------SRNNKDFMLLQPEQNSSFTEDK----SQNDLNNQVTHE
SEQ_ID_NO:8      (33)   KHSGEQSKRQ---VNSFNSHGDSSLRGDPVDRRQDR-SGGNLVKSWTKDHN
SEQ_ID_NO:20      (1)   --------------------------------------------------
        Consensus (201) KHS DQ KK      E   DQ  N                     E 251                                              300
SEQ_ID_NO:16      (1)   ------------------------XL----DEDDDRKSIGSNAVDAVQE
SEQ_ID_NO:2     (207)   KKPHPAAFKRFASNFRESSPVNVKLQE---VENVEARVINNINDAVQE
SEQ_ID_NO:22    (240)   KKPHPAAFKRFASNFRESSPVNVKLQE---VENVEARVINNINDAVQE
SEQ_ID_NO:26    (124)   VRG-PLPSAFASNEGKSPVERMELQA---VLSAFELINSAPSKSRGPE
SEQ_ID_NO:28    (223)   ASS----FTRPTSSFREKSDVIRSQSPR-AYSEATEQSSSYSVTWTQK
SEQ_ID_NO:4     (228)   DIVFSSSVAPRSNFQRRDVERLKHQH---VENDENEMTVVPVGSEDTE
SEQ_ID_NO:6      (36)   VQATENRSTEPVSNFQKEEISSFKYKE--------VLTGEESFTPEPFE
SEQ_ID_NO:8      (79)   ASSSSSSFTRFASSFRESSPVERFESPRPTYSNEATFEASSYSVTWTHK
SEQ_ID_NO:20      (1)   ---------------------------------------------RQK
        Consensus (251)        RP SNF RRSPVP   F P   T  D D          QK 301                                              350
SEQ_ID_NO:16     (22)   AKTALDERTATLEPDSMSPYE-----EDSVIEEG-NESLNDLEDILEEE-
SEQ_ID_NO:2     (254)   AKPTLENKAATDEPDSVSTFE-----ENSVIEPE-NLSLDDLEHISELEP
SEQ_ID_NO:22    (287)   AKPTLENKAATDEPDSVSTFE-----ENSVIEPE-NLSLDDLEHISELEP
SEQ_ID_NO:26    (170)   KETGDYECVQAAPAESVVLDG-----------EELSSDDQLHSGSLET
SEQ_ID_NO:28    (268)   KDTVELHDEPEHEPAYEHEHE-----ENESEEGPVTELEPESELKPES
SEQ_ID_NO:4     (275)   NNQDQIELKLDLEAESDFESDVDS--KEFFFENIGMAELSEDDSEQTY
SEQ_ID_NO:6      (78)   RKEARHSPESTPEVKIKGSE-----EVESQAFDGEDESSDEDIEEVAD
SEQ_ID_NO:8     (129)   KDTAESHDEPELELQAEIAPEYDEHAEEYESEEPVAAELEPESDLHLEA
SEQ_ID_NO:20      (4)   AKTVLDERTVTLEPDKMSPYE-----EDSVIEPE-NLEDLEDILEIE
        Consensus (301) KT   E   TDEPDSVS  E       PD  EPE  ISL DLD I DDE 351                                              400
SEQ_ID_NO:16     (65)   EEFDAEEPD---------DEYPEPSLGISDVTDTEESHENDSTP-TESA
SEQ_ID_NO:2     (298)   DASDTEEPS---------GEYDEPSLQIPSVPIIEESHETTLKSSLEGP
SEQ_ID_NO:22    (331)   DASDTEEPS---------GEYDEPSLQIPSVPIIEESHETTLKSSLEGP
SEQ_ID_NO:26    (209)   AEETIES------------------ES------------------TEASP
SEQ_ID_NO:28    (313)   SSFYQEEDDDVTFDVLSQDDGILDVESDDDESLDEADEESDEAEEEAVK
SEQ_ID_NO:4     (323)   NDESVEEQP-----------------------------------AAQHK
SEQ_ID_NO:6     (123)   EIDDSEEPN-----------------------------------AIEDK
SEQ_ID_NO:8     (179)   SSFYQEE----------EHNVTLDAESEEEESLDEADEE-VEEEAVKDE
SEQ_ID_NO:20     (48)   ESDTDEPDD------------EYPEPSLEITDVTDTDLHENNSTESS
        Consensus (351) ES    EE             SL    D     D       A G
```

FIGURE 10 B (continued)

```
                       401                                                450
SEQ_ID_NO:16   (104)   DLSSLKVAELRELAKSRGIKGYSKKKNELVEVLSSSMDDDKVGDLAL--
 SEQ_ID_NO:2   (338)   DLKTLKVTELRELAKSRGIKGYSKMKKNDLVELLSNMA-----------
SEQ_ID_NO:22   (371)   DLTIKKVTKLRELAKSRGIKGYSKMKKNDLSQGTDWEDFLGIVCLPIINS
SEQ_ID_NO:26   (223)   DLGSSKLSELRLARYRGIKGYKMKKGELAEHLSA---------------
SEQ_ID_NO:28   (363)   DLSEIKIVELRGIAKSRGIKGLSKIKKAHLVELLGSDSS-----------
 SEQ_ID_NO:4   (337)   DLSALKLSELRALAKSRGIKGFSKLKSDLVELLTET--------------
 SEQ_ID_NO:6   (137)   DLSNKIVELRAVAKSRGIKGLSFIKKASLLELLTS---------------
 SEQ_ID_NO:8   (217)   DLSTKKMELEGIAKSRGIKFSKNKKAQIVELLSSDSS-------------
SEQ_ID_NO:20    (84)   DLTSLKVAELRELAKSRGIKGYSKMKKNELVEVVSSSMA-----------
   Consensus   (401)   DLSSLKL ELRELAKSRGIKGYSKMKK ELVELLSS 451                                                500
SEQ_ID_NO:16   (152)   --------------------------------------------------
 SEQ_ID_NO:2   (376)   --------------------------------------------------
SEQ_ID_NO:22   (421)   TISFIKENNAGDAAAALMSRLALKTKVLRDEQWQELDASTLVPGDIISIR
SEQ_ID_NO:26   (259)   --------------------------------------------------
SEQ_ID_NO:28   (402)   --------------------------------------------------
 SEQ_ID_NO:4   (374)   --------------------------------------------------
 SEQ_ID_NO:6   (173)   --------------------------------------------------
 SEQ_ID_NO:8   (256)   --------------------------------------------------
SEQ_ID_NO:20   (123)   --------------------------------------------------
   Consensus   (451)

501                                                550
SEQ_ID_NO:16   (152)   --------------------------------------------------
 SEQ_ID_NO:2   (376)   --------------------------------------------------
SEQ_ID_NO:22   (471)   FGDIVPADACLLEGDPLKMNCHTPFMRKMSITGIQLSLVNPFLSPKEPGT
SEQ_ID_NO:26   (259)   --------------------------------------------------
SEQ_ID_NO:28   (402)   --------------------------------------------------
 SEQ_ID_NO:4   (374)   --------------------------------------------------
 SEQ_ID_NO:6   (173)   --------------------------------------------------
 SEQ_ID_NO:8   (256)   --------------------------------------------------
SEQ_ID_NO:20   (123)   --------------------------------------------------
   Consensus   (501)

551                                                600
SEQ_ID_NO:16   (152)   --------------------------------------------------
 SEQ_ID_NO:2   (376)   --------------------------------------------------
SEQ_ID_NO:22   (521)   IVFTGSTCKHGEIEAVVIATGIHSFFGKAAHLVDSTEVVGHFQKLCVFFS
SEQ_ID_NO:26   (259)   --------------------------------------------------
SEQ_ID_NO:28   (402)   --------------------------------------------------
 SEQ_ID_NO:4   (374)   --------------------------------------------------
 SEQ_ID_NO:6   (173)   --------------------------------------------------
 SEQ_ID_NO:8   (256)   --------------------------------------------------
SEQ_ID_NO:20   (123)   --------------------------------------------------
   Consensus   (551)
```

FIGURE 10 B (continued)

```
                    601                                                    650
SEQ_ID_NO:16  (152) --------------------------------------------------
 SEQ_ID_NO:2  (376) --------------------------------------------------
SEQ_ID_NO:22  (571) LSQRMQGLPQSFHQNMNHHCLDLGCLDGLVEGGAVYDGGGGFPSILYTRI
SEQ_ID_NO:26  (259) --------------------------------------------------
SEQ_ID_NO:28  (402) --------------------------------------------------
 SEQ_ID_NO:4  (374) --------------------------------------------------
 SEQ_ID_NO:6  (173) --------------------------------------------------
 SEQ_ID_NO:8  (256) --------------------------------------------------
SEQ_ID_NO:20  (123) --------------------------------------------------
   Consensus  (601)

651         663
SEQ_ID_NO:16  (152) -------------
 SEQ_ID_NO:2  (376) -------------
SEQ_ID_NO:22  (621) IIGQCTTLIFACS
SEQ_ID_NO:26  (259) -------------
SEQ_ID_NO:28  (402) -------------
 SEQ_ID_NO:4  (374) -------------
 SEQ_ID_NO:6  (173) -------------
 SEQ_ID_NO:8  (256) -------------
SEQ_ID_NO:20  (123) -------------
   Consensus  (651)
```

SEQ ID NO 210, DNA - Oryza sativa
ATGCTGCTTCCGCCGCATCCAGGCAGAACATTACCAGCCTATCATGGAGACAACAGATTTCTTCTT
GGAGCTTGTTTCCTGAGTAAACTGCCTATGCTGCGCCCAATGAAGTTGTCTTTGGTATGCAGTGCT
AATCCCAACAACCATAGGTCAAGAAGTTCGGATATCACACGCCATCAGAAGGGTGGATCAGCTCGG
AGGAAAAGTAAGCCTTACCAGGAGAAAGATGACTCTGAGAATATTGATGAATTCGATACTGATATT
ATGTCCTCCAAAAATGGACCACCCATCTCTTTGACAAGCAATTCCCGTCCTCAAGCAACATCAGTC
CCAGGGGAAAGAGAGAAGGAGATAGTAGAGTTGTTTAAAAGGGTTCAAGCACAATTGCGAGCAAGG
GGAAAAGGGAAGGAGGAGAAGAAGCCTGAACAAGCAAAAGCACAGGGTGAGAGGGGCAGTGTTGAC
TCCCTTCTAAATCTGCTTAGGAAGCACTCAGTGGACCAACGAAGGAAGAGCGGTGATGAGAAAGAA
CAGAGTGTTGACCAAACAAAGAGAAGCAATGAATCTGGAAATAAACAAAATTCAAGCATCTTCATA
AAGAATGACACTCAGGAAGAACAGAAAAAGCCACATCCTGCAGCCTTCAAAAGGCCAGCTTCAAAT
TTTAGGCGAAGATCCCCTGTTCCTAATGTAAAGTTCCAGCCTGTTACCAATGTTGATGCCGAACGA
GTCATCAATAACATCAATGATGCCGTACAAGAGGCTAAGCCAACTTTGGAAAATAAGGCTGCTACA
GATGAACCAGACTCGGTTTCTACATTCGAACCTAATTCTGTAATAGAACCAGAAAACCTATCTTTG
GATGACCTTGATCATATTTCAGATGATGAACCTGATGCTTCTGATACTGATGAACCCAGTGGAGAA
TATGATGAGCCATCTTTGCAAATCCCAAGTGTTCCAATTATTGATGAATCTCATGATACGACACTG
AAATCTTCCTTAGGAGGTCCTGATTTAAGCACTTTGAAGGTCACAGAACTAAGAGAACTTGCGAAA
TCTCGAGGAATCAAAGGATATTCCAAGATGAAGAAGAATGACCTGGTTGAACTGCTGAGCAACATG
GCTTGA

SEQ ID NO 211, PRT - Oryza sativa
MLLPPHPGRTLPAYHGDNRFLLGACFLSKLPMLRPMKLSLVCSANPNNHRSRSSDITRHQKGGSAR
RKSKPYQEKDDSENIDEFDTDIMSSKNGPPISLTSNSRPQATSVPGEREKEIVELFKRVQAQLRAR
GKGKEEKKPEQAKAQGERGSVDSLLNLLRKHSVDQRRKSGDEKEQSVDQTKRSNESGNKQNSSIFI
KNDTQEEQKKPHPAAFKRPASNFRRRSPVPNVKFQPVTNVDAERVINNINDAVQEAKPTLENKAAT
DEPDSVSTFEPNSVIEPENLSLDDLDHISDDEPDASDTDEPSGEYDEPSLQIPSVPIIDESHDTTL
KSSLGGPDLSTLKVTELRELAKSRGIKGYSKMKKNDLVELLSNMA

SEQ ID NO 212, DNA - Glycine max
ATGTCGCAAACGCTGCACGCTTTCGTCGCCAAAAACCTTGGATGTGGAATGGCATACGGCAAGTGT
CTCCCATGTTCAGGTGTTTCTGGAAGAACTGCTGCTGTATATTCCTACTCTTCTCTAGGTCATCGC
AGAATTCATTCCCATGTCCAAGTTAGAGGACTAAAGTGTGGCTTTAGGGGTGCATCTTTTGTATGT
GAAGCAAAGAGGAACCCAGATTTCTCAAGGCAAAACAAGCATGGGTCCTCCAGAAGCAGAAATCGG
AATAGTGATGGGAGAGACAGCTTTGAGAGCTTTGACGACGATATGTTTCTTTAAAAAATGGACCA
CCTGTGTCTCTTTCAACCTCAGGAAAATTCCAGGCCACTTCAGCCCCTGGTCCTAGGGAGAAGGAG
ATTGTTGAGCTATTTAGGAAGGTCCAGGCTCGGCTGCGTGAGAGGGCTGCCTCCAAAGAAGAAAAG
AAAGTTGAAGCCTCCCGAGCACAAAGCAAAGAGAACAGTACTGTGGATTCCCTTCTCAAACTACTG
AAGAAACATTCAGTTGAGCAAGTGAAGAGAAGTAGTGGAGGCAGAGGAAAAGATTTTAGTTCAGAC
CAGTTGCAAGAAAGTAACCAATACAATGGAGGACGGAACTCTAAAATTTCTGATTTAGATAGTTCT
CCAAAGGATGAGCCCCAAGAGGACATTGTCTTCTCTTCCTCGGTAGCCAGGCCTCGGTCAAATTTC
CAAAGAAGGTCTCCCGTTCCTCGTTTAAAATACCAGCATGTCTCTAACGATGAGAATGAAATGACT
GTAGTGCCAGTAGGTAGTGAGGATACAGAGAACAATCAGGATCAGATAGATTTGAAGCTTGATGAC
GAAGCTGAATCTGACTTTGAATCGGATGTTGATTCAAAGGATGAGTTTTCTTCCCAAACATAGGG
ATGGCTGAATTGTCTGAGGATGATGATTCTGAGCAAACCTATAATGATGAGAGTGTGGAGGAGCAG
CCGGCAGCTCAACACAAGGATTTGAGTGCACTGAAGCTGTCCGAATTGAGGGCACTTGCAAAGACT
CGTGGCCTGAAAGGATTCTCAAAAATGAAGAAGAGTGACCTCGTGGAGTTGCTAACTGAGACCTGA

FIGURE 12

SEQ ID NO 213, PRT - Glycine max
MSQTLHAFVAKNLGCGMAYGKCLPCSGVSGRTAAVYSYSSLGHRRIHSHVQVRGLKCGFRGASFVC
EAKRNPDFSRQNKHGSSRSRNRNSDGRDSFESFDDDMFSLKNGPPVSLSTSGKFQATSAPGPREKE
IVELFRKVQARLRERAASKEEKKVEASRAQSKENSTVDSLLKLLKKHSVEQVKRSSGGRGKDFSSD
QLQESNQYNGGRNSKISDLDSSPKDEPQEDIVFSSSVARPRSNFQRRSPVPRLKYQHVSNDENEMT
VVPVGSEDTENNQDQIDLKLDDEAESDFESDVDSKDEFFFPNIGMAELSEDDDSEQTYNDESVEEQ
PAAQHKDLSALKLSELRALAKTRGLKGFSKMKKSDLVELLTET

SEQ ID NO 214, DNA - Tagetes spp.
AAAGCACAACCACCAGCAGAAACAATAAAGATTTCATGTTAGACAACCAACCCGAGCAGAACAGTT
CATTTACAGAAGATAAAAGTCAAAACGACTTGAATAACCAGGTCACACACGAGGTCCAAGCTACTG
AAAACCGATCTACAAGACCTGTATCAAATTTCCAAAAGAGGTCGCCAATTTCTAGCTTCAAATACA
AACCAGTTTTGACTGGTGAAGAGTCTTTCACCCCTGAACCATTTAAAAGGAAAGAAGCAAGACATG
AGCCTGAGTCAACACCTGAGGTCAAAATCAAGACTGGGTCTGAGCCAGAAGTTGAAAGTCAAGCCT
TTGATGGGTTTGATGAAAGTTCAGATGATGACATTGAAGAGGTTGCTGATGAGATTGACGATTCAG
AAGAACCAAATGCGATTGAAGATAAGGATTTGAGCAGCATGAAGCTGGTTGAGTTAAGAGCAGTGG
CTAAATCAAGAGGCATCAAGGGGTTGTCTAAGCTGAAAAAAGCCGAGTTATTGGAGTTGCTGACTA
GTTGAAAGTTTACATGTTATGGAACCTTTTCATTATAATGTACCATAGAATTTGAGTTGTTCTTTT
GATCTTTTCTATCTTTCTATATTTATGTGATGTTATTATCTTTATG

SEQ ID NO 215, PRT - Tagetes spp.
SRNNKDFMLDNQPEQNSSFTEDKSQNDLNNQVTHEVQATENRSTRPVSNFQKRSPISSFKYKPVLT
GEESFTPEPFKRKEARHEPESTPEVKIKTGSEPEVESQAFDGFDESSDDDIEEVADEIDDSEEPNA
IEDKDLSSMKLVELRAVAKSRGIKGLSKLKKAELLELLTS

SEQ ID NO 216, DNA - Brassica napa
GGGTCGACAACGAAGGAGCTTTTTAGAATAGTTCAAGCTCGGCTGCGAGCTCGAGCAGCGACCAAG
ATGGAAGATAAAAAGGCACAAGAAGAAGAAGAAGAAGCTTCTAAAGGACGGGGAAAAGAAAGTGAA
ACTGTTGACTCTCTTCTTAAGTTACTAAGAAAGCATTCGGGAGAGCAGAGCAAAAAAGTTAACAGT
TTTAACAGCCATGGAGACAGTTCGCTACGAGGAGATCCTGTGGACAGGAGGCAAGATCGCAGCGGA
GGAAACCTTGTCAAGTCATGGACCAAAGATCATAATGCATCATCATCATCATCATCCTTTACCAGG
CCAGCGTCAAGCTTCAGAAGAAAGTCGCCAGTACCAAGATTTGAATCACCTCCTCCGACTTATTCT
AATGAGGCAACTTTTGATGAGGCATCGAGTTACAGCGTGACTTGGACCCATAAGAAGGATACAGCA
GAGTCGCATGACGAACCTGAAGACGAACTTCAGGCTGAGATTGCGCCTGAGTACGACGAACATGCA
CCTGAATATGAGTCAGAACCTGACCCTGTGGCAGCTATTCTCGAACCAGAGTCAGATCTGCATCTA
GACGCATCATCATTTTACCAAGAGGAGGAGCATAATGTTACTTTAGATGCGTTATCCGAGGAGGAG
GAGTCTCTGGATGATGCTGATGAAGAGGTTGAGGAAGAAGCTGTAAAAGACGAGGACTTGAGTACA
TTGAAGCTGATGGAACTGAGAGGCATAGCAAAATCAAGGGGACTAAAAGGGTTTTCAAAGATGAAG
AAAGCCCAACTCGTGGAGTTGCTTAGTAGTGATTCCAGCTGATTCGACGGTGAAAGAATCTCAACA
AATAATAAGAACATTTACTCTCGTTAGTGACAGTGTTGAAATGAGTTAATTTCTGTGTTCTTTCTT
TTACCTGGAAATACTGGCCGTGATCATGTTTGTTTACTCAGATTTTAAACTTTGGTTTTTGAAGAT
CTTCGA

SEQ ID NO 217, PRT - Brassica napa
MEDKKAQEEEEEASKGRGKESETVDSLLKLLRKHSGEQSKKVNSFNSHGDSSLRGDPVDRRQDRSG
GNLVKSWTKDHNASSSSSSFTRPASSFRRKSPVPRFESPPPTYSNEATFDEASSYSVTWTHKKDTA
ESHDEPEDELQAEIAPEYDEHAPEYESEPDPVAAILEPESDLHLDASSFYQEEEHNVTLDALSEEE
ESLDDADEEVEEEAVKDEDLSTLKLMELRGIAKSRGLKGFSKMKKAQLVELLSSDSS

FIGURE 12 (continued)

SEQ ID NO 218, DNA - Hordeum vulgare
CAACTCTCACTCCATTAGAGAACAGCAAGGAGGTCAGCTTCGGTTCTTTGGCAGAGGAAGAAGAGA
GAAGAAATGGGAGCAATTCTCATGCAGCATCACCAAATCTCTCGCAATCCTCTACAAAAAGTCATC
TTCCCCGGATCATTTGCTCTCCAAAGAGATATTGTTCTCCATCGCGCTCCACGACGGGGTTCTCTA
CCGTGCTCATCTTCATTGACGGTCAGAGCAGAAGCCAACGGGTACTCACCTTCAAGAATGGCGGTC
AAGAAGCACAGCAAAGAAGAGCTCATAGAATTCTTCGGGGCCATCCAGGCCGCCATTGCCAGGGAC
TCGCCCAAGGCGCCCGGGAGGACGAGGAAGCCGTCGTCGCCGGCTGACACGCTCGAAGAGGCTGGC
ACGAAGATGCAACCATACGAGGAACTGCACCAAGACGGGCAGCCAAATTTGGAGGACATGAAGGTG
CCTGAGCTGAGGGACATGGCGAGGGAGAGGGGGATGAGAGGTTACTCCAAGCTGAAGAAAGGGGAG
CTGATTGATCGTCTGAGGGGTGCCTGGTCGTCTGATAATTAACAAGCCTTCCTCTCCGAGATAGGA
ACAGGCAGCCGCCAGTGCTGGCTGTTTGGCCCAATTGGTGCAGCTTACAATCGACTTTTCTTGCGT
CTGTTGTTTTCTTTGTTAGATACAGTATCTTCCAAAGAGGCAGAAGCTCTGCAGTTGGACACTAGG
TCTGCATTGTTTTCTTGCATCTATCCTTTGCATGGTCTGTTTGTACTCCCTCCCTACCTAAATAAT
TGTAGTTGGGAAGTACAGAGGGAGTAGTTTTGTTGCTTTCATTTTCGTATCGTCAAGTTTCTGAAT
TTCAACCCACCTTACGATAAAAAAAAAAAAAAAAAA

SEQ ID NO 219, PRT - Hordeum vulgare
MGAILMQHHQISRNPLQKVIFPGSFALQRDIVLHRAPRRGSLPCSSSLTVRAEANGYSPSRMAVKK
HSKEELIEFFGAIQAAIARDSPKAPGRTRKPSSPADTLEEAGTKMQPYEELHQDGQPNLEDMKVPE
LRDMARERGMRGYSKLKKGELIDRLRGAWSSDN

SEQ ID NO 220, DNA - Triticum aestivum
AGCCTCCCCGTACGAACCCGACTCTGTGATAGCACCAGAAGATGCATCTCTGGACGACTTTGTTGT
CTCAGACGATGAATCAGACGTGCTAGATACCGATGAACCCGATGAGTACCTGGAACCATTCGATAA
TGCTGATGATGTTACAGATAGCATCCCATCCCATGATGACAGTCTGGAAGGTAGTCCTTCCGTGGA
AGCTTCCGACCTGAGCTCGCTCAAGGTCATGGAGCTGAGGGAGCTGGCGAAATCTCGGGGACTCAG
GGGCTACTCGAAGATGAAGAAGAGCGACCTGGTCGCACTACTGAGCGACGTGTCCTGATCCGTCGG
TGGTGGCAATCCTGCTTG

SEQ ID NO 221, PRT - Triticum aestivum
SPYEPDSVIAPEDASLDDFVVSDDESDVLDTDEPDEYLEPFDNADDVTDSIPSHDDSLEGSPSVEA
SDLSSLKVMELRELAKSRGLRGYSKMKKSDLVALLSDVS

SEQ ID NO 222, DNA - Triticum aestivum
CGGAAACAAATGCCCCAGCACGGCTTACAGCTTTACTTATTTTAACTCTAATAACAGGGTTCAGC
TAATCGACTAACAAAGCTAGGACATGACAGCAAAAGGGACCAGCAAGAGATCAACGAACAACGGAG
AAAAGGTTAACCCTGCTCATTTACAACGTTCTATCTAAAGGGACTTGGCAGAATAGGAAATGGGA
GGTCGTGCACATGGCCATGGCAGAAGGGGAGCAAAACGGTGGGCTCGAGCAGGATTGCCACCACCG
GCGGATCAGGACACGTCGCTCAGTAGCGCGACCAGGTCGCTCTTCTTCATCTTCGAGTAACCCCGG
AGTCCCCGAGATTTCGCCAGCTCCCTCAGCTCCGTCACCTTGAGCGAGCTCAGGTCGGAAGCTTCT
GC

SEQ ID NO 223, PRT - Triticum aestivum
ASDLSSLKVTELRELAKSRGLRGYSKMKKSDLVALLSDVSDPPVVAILLEPTVLLPFCHGHVHD FIGURE 12 (continued)

SEQ ID NO 224, DNA - Zea mays
ATCTGGACACTGATGACGATCGCAAGTCCATCGGCAGTAATGCCGTGGATGCCGTACAGAAAGCTA
AGACAGCTCTTGATGAGAGGACTGCTACAGATGAGCCTGACTCCATGTCTCCATATGAGCCAGATT
CTGTAATAGAACCAGGAAACATTTCTTTGAATGACCTCGATGACATTTTAGATGACGACGAAGAAT
TCGATGCAGATGAACCAGACGACGAGTATCCAGAACCTTCTTTGGGAATCTCTGATGTCACAGATA
CGGATGAGTCGCACGAGAACGACTCCACCCCCACGGGAAGTGCGGATCTAAGCTCTCTGAAGGTTG
CGGAGCTGAGAGAGCTCGCAAAGTCTCGAGGAATCAAAGGGTACTCGAAGAAGAAGAAAAACGAGC
TGGTTGAAGTGTTGAGCAGCAGCATGGATTGATGATAAAGTGGGTGACCTGGCGCTCTGTTTGAAG
TTTGAACCCACTTTGCTTGGCCCCCTCTAGAAAATTGTAAATGAGCAAGGCTAACTCTGTTCCGGT
CTGTGCTGATCTTTTGCTGGTTCATTTTGTACGCCTAGCTTGGTAGCCGTTTAGCTGAATTCTGTG
GTGAGTGGAGTAAGGTAGCTGAGAGCCTTAGCTGTTTGTGTACTAAATCAATGCACTGCATCCGTT
CTAGGGTGTTGCTCGTCTGTTTTCCGATATTGTCTTGTTCT

SEQ ID NO 225, PRT - Zea mays
XLDTDDDRKSIGSNAVDAVQKAKTALDERTATDEPDSMSPYEPDSVIEPGNISLNDLDDILDDDEE
FDADEPDDEYPEPSLGISDVTDTDESHENDSTPTGSADLSSLKVAELRELAKSRGIKGYSKKKKNE
LVEVLSSSMDDDKVGDLAL

SEQ ID NO 226, DNA - Zea mays
ATCAAGACTAGCTTGTTTGACCACCAGCTTCCCTACCTTCTCCTGCAATCCCAAGAGAAGATGAAT
TGGTTTGTATCATCATTCATTTGCCTGTGGCAGGAAGTGGATGGAAGCAGGCGGTCATTGGAAGGC
AGGAACAGGGGGCTTTGCTTGGTGTTCTTTGGAGGAGAAAGAAGAGCAAAGAAATGGGAGCTTGC
TCTTGTCGCATCACCAAACCTTTCCAAATTCTTTGCAAGCTTCCATCCCCGGACCTCTCTCTCTTC
ACAAAGGCGACCGCAAAAACCTCCATTGCTTGGCACCTGATGTGCACCTCCTCTGTTCCCTGCGGC
AAGGCTTTCCACGCTCATCTTGGTCGGCCGTCATCAGATCAGAAGCCAGCGGCAACGCGGTGGCGT
CGCCAGGCACGGTCATCAAGCGTAGCAAGGAGGAGCTCATCACCTTCTTCAGAGACATACAGACAT
CCATTGCCGAGTGCTCGCGTAAAGCTTCCAAGAGGACGAGGAAGCAGCCGCCTGATCTGTTCCAAG
AGGTCCGCAGGAGGGAGGAACAGTCACACGGTGGAGGAGATAGCGGCACCGACGACGTTTCAGAGG
GACCGAGGAAAGTGAAGAGTCTTGAGGACATGAACGTGGCTGGATTGAGAGAGTTGGCGAGGGCCA
GAAGGATGAGGGGTTACTCCAAGCTTAAGAAGGGCGAGCTCATTGATCGGTTGAGAGGGGCTACTA
CGTAATAAACTACCATGATGCAGAGCAGCTTCGCAGTTAATAGGGACACATGTTCTTTCGAACGT
ATGATGAGATTACCGATCAAAAAATTGTATGATGATGAGATTACCGACTTTCCAAACGATCTAGTC
AGTTCATTGATAAGAACTAGAACAATGTGTGTAGTTATTATACTATAGAACCGGTGGAGCTGTATT
GTTGTACTACGCCGAAACTTTTGTGTAGGCATGGCAATCTCCTGTTGTTACGTAAGTTACTTTGTT
ATGTACGGAATTAGTTTCTCTAAA

SEQ ID NO 227, PRT - Zea mays
SCRITKPFQILCKLPSPDLSLXHKGDRKNLHCLAPDVHLLCSLRQGFPRSSWSAVIRSEASGNAVA
SPGTVIKRSKEELITFFRDIQTSIAECSRKASKRTRKQPPDLFQEVRRREEQSHGGGDSGTDDVSE
GPRKVKSLEDMNVXWIERVGEGQKDEGYSKLKKGELIDRXERGYYVINYHDAEQLRS

SEQ ID NO 228, DNA - Triticum aestivum
GAGGCAGAAAGCTAAGACAGTTCTTGATGAGAGGACTGTTACAGATGAGCCTGACTCCATGTCTCC
GTATGAACCTGATTCTGTAATAGAACCAGAAATATTTCTTTGGAAGACCTTGATGACATTTTAGA
TGACGATGAAGAATCTGATACAGATGAACCAGACGATGAGTATCCAGAACCTTCTTTGGAAATCAC
TGATGTTACAGATACAGATGAATTGCACGAGAACAACTCCACGGAAAGTTCAGATCTAACCTCTCT
GAAGGTTGCAGAGCTGAGAGAGCTTGCAAAGTCCCGAGGAATCAAAGGCTATTCAAAGATGAAGAA FIGURE 12 (continued)

```
AAACGAGCTGATTGAAGTGGTGAGCAGCAGCATGGCTTGATGATAAGCGGGTGATATTGTCAACCT
TTCAGTCCCACTTTGCTGATTGAAGTGGTGAGCAGCAGCATGGCTATTCCATTTGAACCCACTTTG
CTTGGCCTGATCCGCTGCCTTTCAGTCCCGTAGAAAATTGTAAATGAGCGAGGCTAACATTGTTCT
GGTCTGTGCTGATCTTTTGCTGGTTCTCATTTTGTACGCCTAGTTTGCTAGACATTTAGCTGAATT
GTGTGCCGAGTGGAGTAAGGTAGCTGAGAGCCTGAGATGCTGTTTGTGTACTAAATGAATGCACCA
CATCTGTTCTAGGTGTTGTTAAAAAAAA
```

SEQ ID NO 229, PRT - Triticum aestivum
```
RQKAKTVLDERTVTDEPDSMSPYEPDSVIEPENISLEDLDDILDDDEESDTDEPDDEYPEPSLEIT
DVTDTDELHENNSTESSDLTSLKVAELRELAKSRGIKGYSKMKKNELIEVVSSSMA
```

SEQ ID NO 230, DNA - Oryza sativa
```
ATGGCCATCTGTATGTCCAACTTCTATGTATCTATATATCTTGTGTACTGCGAACCCTTCAATCTG
AAACATTTAGTTTTCGTCCTTATTCATTACTATGCTATTGTTTCTTGGGTTTCAGGCAGAACATTA
CCAGCCTATCATGGAGACAACAGATTTCTTCTTGGAGCTTGTTTCCTGAGTAAACTGCCTATGCTG
CGCCCAATGAAGTTGTCTTTGGTATGCAGTGCTAATCCCAACAACCATAGGTCAAGAAGTTCGGAT
ATCACACGCCATCAGAAGGGTGGATCAGCTCGGAGGAAAAGTAAGCCTTACCAGGAGAAAGATGAC
TCTGAGAATATTGATGAATTCGATACTGATATTATGTCCTCCAAAAATGGACCACCCATCTCTTTG
ACAAGCAATTCCCGTCCTCAAGCAACATCAGTCCCAGGGGAAAGAGAGAAGGAGATAGTAGAGTTG
TTTAAAAGGGTTCAAGCACAATTGCGAGCAAGGGGAAAAGGGAAGGAGGAGAAGAAGCCTGAACAA
GCAAAAGCACAGGGTGAGAGGGGCAGTGTTGACTCCCTTCTAAATCTGCTTAGGAAGCACTCAGTG
GACCAACGAAGGAAGAGCGGTGATGAGAAGAACAGAGTGTTGACCAAACAAAGAGAAGCAATGAA
TCTGGAAATAAACAAAATTCAAGCATCTTCATAAAGAATGACACTCAGGAAGAACAGAAAAAGCCA
CATCCTGCAGCCTTCAAAAGGCCAGCTTCAAATTTTAGGCGAAGATCCCCTGTTCCTAATGTAAAG
TTCCAGCCTGTTACCAATGTTGATGCCGAACGAGTCATCAATAACATCAATGATGCCGTACAAGAG
GCTAAGCCAACTTTGGAAAATAAGGCTGCTACAGATGAACCAGACTCGGTTTCTACATTCGAACCT
AATTCTGTAATAGAACCAGAAAACCTATCTTTGGATGACCTTGATCATATTTCAGATGATGAACCT
GATGCTTCTGATACTGATGAACCCAGTGGAGAATATGATGAGCCATCTTTGCAAATCCCAAGTGTT
CCAATTATTGATGAATCTCATGATACGACTCTGAAATCTTCCTTAGGAGGTCCTGATTTAAGCACT
TTGAAGGTCACAGAACTAAGAGAACTTGCGAAATCTCGAGGAATCAAAGGATATTCCAAGATGAAG
AAGAATGACCTGAGCCAAGGTACTGATTGGGAGGATTTCCTGGGAATTGTCTGCCTCCCGATTATC
AATTCAACAATCAGCTTCATTAAGGAAAACAATGCAGGCGATGCAGCTGCTGCACTCATGTCCCGG
TTGGCGCTAAAAACAAAGGTTCTTAGAGATGAGCAGTGGCAAGAGCTTGATGCTTCCACATTGGTA
CCTGGGGATATAATCAGCATCAGGTTTGGTGACATTGTCCCTGCAGATGCGTGCCTACTTGAGGGA
GATCCTCTGAAATGAATTGCCACACGCCGTTCATGCGAAAGATGTCGATCACTGGAATTCAGCTC
TCACTGGTGAATCCCTTCCTGTCACCAAAAGAACCGGGGACCATAGTGTTCACTGGCTCAACATGC
AAGCATGGTGAGATTGAAGCTGTTGTCATTGCAACTGGGATACACTCTTTCTTTGGCAAGGCAGCT
CATCTAGTGGACTCCACTGAGGTTGTTGGGCATTTTCAGAAGCTTTGCGTTTCTTCTCCTTATCA
CAAAGAATGCAAGGACTGCCCCAGAGCTTCCACCAAAACATGAACCACCATTGTCTTGACCTGGGC
TGTTTGGACGGTTTGGTGGAGGGGGAGCTGTATATGATGGAGGTGGTGGATTTCCGTCAATTCTG
TACACAAGGATCATAATAGGTCAGTGTACAACTCTCATTTTTGCATGTTCATAA
```

SEQ ID NO 231, PRT - Oryza sativa
```
MAICMSNFYVSIYLVYCEPFNLKHLVFVLIHYYAIVSWVSGRTLPAYHGDNRFLLGACFLSKLPML
RPMKLSLVCSANPNNHRSRSSDITRHQKGGSARRKSKPYQEKDDSENIDEFDTDIMSSKNGPPISL
TSNSRPQATSVPGEREKEIVELFKRVQAQLRARGKGKEEKKPEQAKAQGERGSVDSLLNLLRKHSV
DQRRKSGDEKEQSVDQTKRSNESGNKQNSSIFIKNDTQEEQKKPHPAAFKRPASNFRRRSPVPNVK
```

FIGURE 12 (continued)

FQPVTNVDAERVINNINDAVQEAKPTLENKAATDEPDSVSTFEPNSVIEPENLSLDDLDHISDDEP
DASDTDEPSGEYDEPSLQIPSVPIIDESHDTTLKSSLGGPDLSTLKVTELRELAKSRGIKGYSKMK
KNDLSQGTDWEDFLGIVCLPIINSTISFIKENNAGDAAAALMSRLALKTKVLRDEQWQELDASTLV
PGDIISIRFGDIVPADACLLEGDPLKMNCHTPFMRKMSITGIQLSLVNPFLSPKEPGTIVFTGSTC
KHGEIEAVVIATGIHSFFGKAAHLVDSTEVVGHFQKLCVFFSLSQRMQGLPQSFHQNMNHHCLDLG
CLDGLVEGGAVYDGGGGFPSILYTRIIIGQCTTLIFACS

SEQ ID NO 232, DNA - Oryza sativa
ATGGGATTCTGCTTTGTCCTCCACGGAATAGCTTCTCATGCTCATCGTTGGGGAGCATCAGGTCAG
AAGCAAATGGATCTCCGTTGCCAAGAACGGTTAATAGGCGTAGCAAGAAGAGCTCATTGAGTTCT
TCAAAAGCATCCAGACCTCCATTGCCGAGGAATCGCCAAGAACTTCGAGGAGGACGAGGAAGCAAT
CATCTGACCCGTTCGAAGAGGTTGAGAGGAGGAAGCAGTCATACGCTAGGCATAGCTGATGTTTCG
GAGGAACATGCAGATGGGGAGCCAAAGGCGCTGGATCTGAATGATATGAAGGTGGCTGAGCTGAGA
GAATTGGCGAGGGCGAGAAGGATGAAAGGTTACTCGAGGCTGAAGAAGAGTGAGCTGATTGATCGT
CTGAAGGGTGTCTGA

SEQ ID NO 233, PRT - Oryza sativa
MGFCFVLHGIASHAHRWGASGQKQMDLRCQERLIGVAKKSSLSSSKASRPPLPRNRQELRGGRGSN
HLTRSKRLRGGSSHTLGIADVSEEHADGEPKALDLNDMKVAELRELARARRMKGYSRLKKSELIDR
LKGV

SEQ ID NO 234, DNA - Musa balbisiana
ATGGATTTTATGTCCAAAAATGGGTCATTGCTTTCTCCAAGTACTAATACTAGATATCAGGCTACT
GCAACTTCAGGACAAAGAGAGAGAGAAATAGTTGAGCTGTTTCGGAAAGTTCAAGCACAATTACGA
GAGCGGGCTGCAATCAAGGAAGAGAAGAAGATTGAAGCCGCACAACAGGGTCAAAGCAAGAAGGGA
ACTGTCGATTCGGTTCTCAAATTATTAAGGAGGCATTCAGGGGATCAGAAGAAGACAACTAGTCCA
GGAGAGGAATTTTCTGTTGACCAAGTAGAAAGAAGCAACACATTTGAGGATGAGCAGAATATAAAT
CCCTTTGGCCCTAGTGATAGCAAGTCACAGGAGTCTGATGTACGAGGCCCTCTTCCTTCTGCTAGG
CCTGCCTCAAATTTTGGTAGAAAATCTCCTGTTCCTAGAATGGAGTTCCAAGCTGTACTTTCAGCA
GAGGAGGATATCAACTCTGCTCCTTCCAAGTCACGAGGGAGAAGGAAGAAGACTGGCGATTATGAG
TGTGTGCAAGCAGCACCTGCGGAGTCTGTTGTGTTGGATGGTCCAGATGAGTTATCATCAGATGAT
CAGTTGGATCATTCTGGTTCTGATGAAACAGCTGAAGAAACTATAGAATCATCTTCTACGGAAGCT
TCTCCTGATTTGGGTTCCTTGAAACTTTCAGAATTGAGGGATCTTGCAAGGTATCGAGGGGTCAAA
GGGTATTCCAAACTCAAGAAAGGAGAACTGGCTGAATTATTGAGTGCTTGA

SEQ ID NO 235, PRT - Musa balbisiana
MDFMSKNGSLLSPSTNTRYQATATSGQREREIVELFRKVQAQLRERAAIKEEKKIEAAQQGQSKKG
TVDSVLKLLRRHSGDQKKTTSPGEEFSVDQVERSNTFEDEQNINPFGPSDSKSQESDVRGPLPSAR
PASNFGRKSPVPRMEFQAVLSAEEDINSAPSKSRGRRKKTGDYECVQAAPAESVVLDGPDELSSDD
QLDHSGSDETAEETIESSSTEASPDLGSLKLSELRDLARYRGVKGYSKLKKGELAELLSA

SEQ ID NO 236, DNA - Arabidopsis thaliana
ATGGCGATGTCGGGAACTTTCCATTTGACTTCTGACTATGTCCCTGGTTACACACTTTCAGACAGC
CGTTGCTTCTTTAACTCTGCTGTTTCAAGAAGAACACTTGCCATATTACCTTGCTCTTCCTGTCTC
GATCACAAGAATGGGCGTCTGAAATCTGTCCCCAATAGAAGTTCTTTTGTGTGCCGAGCAAGTTCT
GGCGGCTATAGGAGAAATCCTGATTTCTCAAGACTTAATAAGCATGGTTACCGGGGAAACAACAGG
CAAAGCGGAGGGAGAGAAGATTTTGATATCGAAAACTCTGATATGTTGTCTTCAAGAAATGGGCCT FIGURE 12 (continued)

```
TTATTCAACCTGTCTAGTTCCCCCAAATTCCAAGCTACCTCATCCCCTGGACCTAGAGAGAAAGAG
ATCGTGGAGCTTTTCAGAAAGGTTCAAGCTCAGCTCCGAGCTCGTGCTGCAGCAAAGAAAGAAGAA
AAAAAGATTGAAGAAGCTTCTAAAGGGCAGGGAAAAGAAAGTGAAACTGTTGACTCTCTTCTTAAG
TTACTAAGGAAGCACTCGGGAGAGCAAAGCAAGAGGCAAGTTAGCAAATTTAGCAGCCAGGGAGAA
GTACAAGGAGATACTGTTGACAAACAAGATCGCACCGGAAATCTTGTCACTTCAGGGAACAAAGAT
AATAATGCATCATCCTTTACCAGACCAACATCAAGCTTCAGAAGAAAGTCGCCAGTACCAAGATCT
CAATCACCGCCAGCTTATTCTAGCGAGGCAACTTTTGATCAATCATCAAGTTACAGTGTAACCTGG
ACCCAGAAGAAGGATACAGTAGAGTTGCATGATGAGCCTGAACATGAGCCTGCGTATGAGCATGAG
CATGAGCCTGAAAATGAGTCAGAACCTGGGCCTGTGACAACTATGCTTGAACCAGATTCAGAGCTG
AAACCAGAGTCATCATCATTTTATCAAGAGGAGGAGGATGATGATGTTACTTTTGATGTGTTATCA
CAGGATGATGGTATTTTAGATGTGTTATCAGATGATGATGAGTCTCTCGATGATGCTGATGAAGAT
AGTGATGAAGCTGAGGAAGAAGCCGTGAAAGACTTGAGTGAATTGAAGCTGGTCGAACTTAGAGGC
ATAGCAAAGTCACGGGGACTAAAAGGGTTGTCAAAGATGAAGAAAGCCGAATTAGTGGAGTTGCTT
GGTAGTGATTCCAGCTGA
```

SEQ ID NO 237, PRT - Arabidopsis thaliana
```
MAMSGTFHLTSDYVPGYTLSDSRCFFNSAVSRRTLAILPCSSCLDHKNGRLKSVPNRSSFVCRASS
GGYRRNPDFSRLNKHGYRGNNRQSGGREDFDIENSDMLSSRNGPLFNLSSSPKFQATSSPGPREKE
IVELFRKVQAQLRARAAAKKEEKKIEEASKGQGKESETVDSLLKLLRKHSGEQSKRQVSKFSSQGE
VQGDTVDKQDRTGNLVTSGNKDNNASSFTRPTSSFRRKSPVPRSQSPPAYSSEATFDQSSSYSVTW
TQKKDTVELHDEPEHEPAYEHEHEPENESEPGPVTTMLEPDSELKPESSSFYQEEEDDDVTFDVLS
QDDGILDVLSDDDESLDDADEDSDEAEEEAVKDLSELKLVELRGIAKSRGLKGLSKMKKAELVELL
GSDSS
```

SEQ ID NO 238, DNA - Arabidopsis thaliana
```
ATGGACTTGGCTCTTCATTGTCATTGTGCTTACCCGTTGATCAAACTAGGATTCATGAGAGCTAAA
TCAGCCAATCATCTTCATGTTCGAGATACTCATTCACTGCCGTTTGCGTTGCGCTTTGAGCAGAGT
CTTTCGAGAACAACGATTAATGGAGATAGAAGTATTTGGTTTCAAGAGAAAGGTGGTTCTTCTTAT
ACTTCAATGGGAAGATCCAAGAAAGGATGTGTTTGTTGCAAGAAACCGTCTGATAGACGAACGTCA
AACCCAAGTAAATCGAACCAAGAGGAGATCATTTCGCTCTTGAAACGGATTCAATCTTCGATCTCT
AAAGGAGAGTCTCGAGGAGTCGAGGAAGAGAAGAACAGCGATGAGTCTTCTAAGGAAAAGCCGCTG
ACCAAAGCTATTCTTGACGTTCTTGAGAAATCAAGAAAAAAACTGAGGGTAATCAACTATGCTTT
GGAGATACTAGTGTGAAGGAGAAGCCACCAAAGAGACAAGTAGAGCTTCCTCGACCACCGTCTAGT
TTTGTCAAGAGAACTCCTTTATCTTCTTCTGCCTCAGGTCCAAGAGGTAAGCTCCCAGTATCAAAC
AGCGATAAAGCTTTAGGAAAATTGACAAAGAAGGAAGAGAAAGCTTCACTGATAGAAACTATGAAA
CTTGCAGAGCTCAAAGAAGTTGCAAAGAACAGAGGAATCAAAGGATACTCAAAGTTGAGGAAGAGT
GAACTATTGGAGCTGATAAGATCGTCCTGA
```

SEQ ID NO 239, PRT - Arabidopsis thaliana
```
MDLALHCHCAYPLIKLGFMRAKSANHLHVRDTHSLPFALRFEQSLSRTTINGDRSIWFQEKGGSSY
TSMGRSKKGCVCCKKPSDRRTSNPSKSNQEEIISLLKRIQSSISKGESRGVEEEKNSDESSKEKPL
TKAILDVLEKSRKKTEGNQLCFGDTSVKEKPPKRQVELPRPPSSFVKRTPLSSSASGPRGKLPVSN
SDKALGKLTKKEEKASLIETMKLAELKEVAKNRGIKGYSKLRKSELLELIRSS
```

SEQ ID NO 240, PRT - Artificial sequence - motif 1 - SAP-consensus
```
XLSSLKVXELRELAKSRGIKGYSKMKKXELVELLS
```

FIGURE 12 (continued)

SEQ ID NO 241, PRT - Artificial sequence - motif 2 - consensus
EKxEIVELFKKVQxxLRxRAxxKxExKxxxExAKAQxxxExxTVDSLLxLLRKHSxDQxKK

SEQ ID NO 242, PRT - Artificial sequence - motif 3 - consensus
RPxSxFxRRSPVP

SEQ ID NO 243, PRT - Artificial sequence - motif 1 of SEQ ID NO:02
DLSTLKVTELRELAKSRGIKGYSKMKKNDLVELLS

SEQ ID NO 244, PRT - Artificial sequence - motif 2 of SEQ ID NO:02
EKEIVELFKRVQAQLRARGKGKEEKKPEQAKAQGERGSVDSLLNLLRKHSVDQRRK

SEQ ID NO 245, PRT - Artificial sequence - motif 3 of SEQ ID NO:02
RPASNFRRRSPVP

SEQ ID NO 246, DNA - Oryza sativa - RCC3 root-specific promoter
TCGACGCTACTCAAGTGGTGGGAGGCCACCGCATGTTCCAACGAAGCGCCAAAGAAAGCCTTGCAG
ACTCTAATGCTATTAGTCGCCTAGGATATTTGGAATGAAAGGAACCGCAGAGTTTTTCAGCACCAA
GAGCTTCCGGTGGCTAGTCTGATAGCCAAAATTAAGGAGGATGCCAAAACATGGGTCTTGCGGGC
GCGAAACACCTTGATAGGTGGCTTACCTTTTAACATGTTCGGGCCAAAGGCCTTGAGACGGTAAAG
TTTTCTATTTGCGCTTGCGCATGTACAATTTTATTCCTCTATTCAATGAAATTGGTGGCTCACTGG
TTCATTAAAAAAAAAGAATCTAGCCTGTTCGGGAAGAAGAGGATTTTGTTCGTGAGAGAGAGAGA
GAGAGAGAGAGAGAGAGAGAGAGAAGGAGGAGGAGGATTTTCAGGCTTCGCATTGCCCAACCTC
TGCTTCTGTTGGCCCAAGAAGAATCCCAGGCGCCCATGGGCTGGCAGTTTACCACGGACCTACCTA
GCCTACCTTAGCTATCTAAGCGGGCCGACCTAGTAGCCACGTGCCTAGTGTAGATTAAAGTTGCCG
GGCCAGCAGGAAGCCACGCTGCAATGGCATCTTCCCCTGTCCTTCGCGTACGTGAAAACAAACCCA
GGTAAGCTTAGAATCTTCTTGCCCGTTGGACTGGGACACCCACCAATCCCACCATGCCCCGATATT
CCTCCGGTCTCGGTTCATGTGATGTCCTCTCTTGTGTGATCACGGAGCAAGCATTCTTAAACGGCA
AAAGAAAATCACCAACTTGCTCACGCAGTCACGCTGCACCGCGCGAAGCGACGCCCGATAGGCCAA
GATCGCGAGATAAAATAACAACCAATGATCATAAGGAAACAAGCCCGCGATGTGTCGTGTGCAGCA
ATCTTGGTCATTTGCGGGATCGAGTGCTTCACAGCTAACCAAATATTCGGCCGATGATTTAACACA
TTATCAGCGTAGATGTACGTACGATTTGTTAATTAATCTACGAGCCTTGCTAGGGCAGGTGTTCTG
CCAGCCAATCCAGATCGCCCTCGTATGCACGCTCACATGATGGCAGGGCAGGGTTCACATGAGCTC
TAACGGTCGATTAATTAATCCCGGGGCTCGACTATAAATACCTCCCTAATCCCATGATCAAAACCA
TCTCAAGCAGCCTAATCATCTCCAGCTGATCAAGAGCTCTTAATTAGCTAGCTAGTGATTAGCTGC
GCTTGTGATC

SEQ ID NO 247, DNA - Artificial sequence - upstream primer
GGGGACAAGTTTGTACAAAAAAGCAGGCTTAAACAATGGCCACAACGATGACAC

SEQ ID NO 248, DNA - Artificial sequence - downstream primer
GGGGACCACTTTGTACAAGAAAGCTGGGTCGGTTTAGGGTTTCTATGCAC

FIGURE 12 (continued)

```
SEQ ID NO 249, DNA - Oryza sativa - protochlorophyllide reductase
promotor
CCCACGCGTCCGCCCACGCGTCCGGGACACCAGAAACATAGTACACTTGAGCTCACTCCAAACTCA
AACACTCACACCAATGGCTCTCCAAGTTCAGGCCGCACTCCTGCCCTCTGCTCTCTCTGTCCCCAA
GAAGGGTAACTTGAGCGCGGTGGTGAAGGAGCCGGGGTTCCTTAGCGTGAGCAGAAGGCCAAGAAG
CCGTCGCTGGTGGTGAGGGCGGTGGCGACGCGGCGGGCCGGTGGCGAGCCCCGGCGCGGGCACGTC
GAAGGCGGACGGGAAGAAGACGCTGCGGCAGGGGTGGTGGTGATCACCGGCGCGTCGTCGGGGCT
CGGGCTCGCGGCGGCGAAGGCGCTTGGCGGAGACGGGAAGTGGCACGTGGTGATGGCGTTCCGCG
ACTTTCCTGAAGGCGGCGACGGCGGCGAAGGCGGCGGGGATGGCGGCGGGGAGCTACACCGTCATG
CACCTGGACCTCGCCTCCCTCGACAGCGTCCGCCAGTTCGTGGACAACTTCCGGCGCTCCGGCATG
CCGCTCGACGCGCTGGTGTGCAACGCCGCACATCTACCGGCCGACGGCGCGGCAACCGACGTTCAA
CGCCGACGGGTACGAGATGAGCGTCGGGGTGAACCACCTGGGCCACTTCCTCCTCGCCCGCCTCAT
GCTCGACGACCTCAAGAAATCCGACTACCCGTCGCGGCGGCTCATCATCCTCGGCTCCATCACCGG
CAACACCAACACCTTCGCCGGCAACGTCCCTCCCAAGGCCGGGCTAGGCGACCTCCGGGGCTCGC
CGGCGGGCTCCGCGGGCAGAACGGGTCGGCGATGATCGACGGCGCGGAGAGCTTCGACGGCGCCAA
GGCGTACAAGGACAGCAAGATCTGTAACATGCTGACGATGCAGGAGTTCCACCGGAGATTCCACGA
GGAGACCGGGATCACGTTCGCGTCGCTGTACCCGGGGTGCATCGCGACGACGGGCTTGTTCCGCGA
GCACATCCCGCTGTTCCGGCTGCTGTTCCCGCCGTTCCAGCGGTTCGTGACGAAGGGGTTCGTGTC
GGAGGCGGAGTCCGGGAAGCGGCTGGCGCAGGTGGTGGGCGACCCGAGCCTGACCAAGTCCGGCGT
GTACTGGAGCTGGAACAAGGACTCGGCGTCGTTCGAGAACCAGCTCTCGCAGGAGGCCAGCGACCC
GGAGAAGGCCAGGAAGCTCTGGGACCTCAGCGAGAAGCTCGTCGGCCTCGTCTGAGTTTATTATTT
ACCCATTCGTTTCAACTGTTAATTTCTTCGGGGTTTAGGGGGTTTCAGCTTTCAGTGAGAGAGGCC
TGTCAAGTGATGTACAATTAGTAATTTTTTTTTACCCGACAAATCATGCAATAAAACCACAGGCTT
ACATTATCGATTTGTCCACCTAAATTAAGTTTCAACTGTTAATTTCTTCGGGGTTTAGGGGGTTTC
AGCTTTCAGTGAGAGAGGCCTGTCAAGTGATGTACAATTAGTAATTTTTTTTACCCGACAAATCA
TGCAATAAAACCACAGGCTTACATTATCGATTTGTCCACCTAAATTAAGT
```

FIGURE 12 (continued)

According to Portis (2003) Photosynth Res 75(1):11-27

FIGURE 15 (continued)

```
                    361                                                             420
      Chlre_RCA (318) FALP  YD M   ITDTG DK  QQ     --QKVAMPKVS D NV  K  KS  D
      Chlli_RCA (312) FALP  YD K   KNTG N S        -KVV  K S NLDI MK  KF  M
      Ostta_RCA (313) FALP  YD K   LSVGY DL      PSKGEEVV  P A  V A  KELE
   Glyna_RCA LF (350) FALP  YD     V  GD                      S
   Aceru_RCA LF (345) FALP  YL   G   D           N-
   Aceru_RCA SF (345) FALP  YD    G D S          N
   Arath_RCA SF (345) FALP  YD   ES G                V   E  Y         M
   Chequ_RCA SF (346) FALP  YD     E  DA          D-
   Desan_RCA SF (336) FALP  YD    ST G            D-               H
   Desan_RCA LF (336) FALP  YD    ST G N          D-          V
   Goshi_RCA SF (348) FALP  YD    GE  NSV         D-          T         AE
   Horvu_RCA LF (335) FALP  YD    GST G           D-
   Lartr_RCA SF (345) FALP  YD    G  S            D-                    E
   Lycpe_RCA LF (344) FALP  YD    GT  S  ER      SD-
   Nicta_RCA SF (349) FALP  YD    GT G   DR      FD-
   Orysa_RCA LF (336) FALP  YD    SDT G N
   Orysa_RCA SF (336) FALP  YD    SDT G N                              V
   Phavu_RCA SF (349) FALP  YD     GV                                  AS
   Triae_RCA SF (339) FALP  YD    GE  NS
Zanae_RCA SF partial (343) FALP  YD    AE  G              L     A
   Zeana_RCA SF (340) FALP  YD    ET G   ARK     L           A
 Horvu_RCA SF II (332) FALP  YD    GE  NS
   Arath_RCA LF (344) FALP  YD   ES G                V   E           M
   Maldo_RCA SF (345) FALP  YD    TG  DS
      Anasp_RCA (219) FSALR  YDLQ    HQK G SP SL V   -A    KK DE AH    V GD
      Nossp_RCA (219) FSALR  YDLQ    HKV G N SL     LL-A    KK D  AH   V KGE
      Synco_RCA (218) FSALR  QL M  N  QE G  N F  KK  V -A   S P  RE S  Q  QA HQ KAE
      Consensus (361) FGALRARVYDDEVRKWVS VGVE IGKRLVNSRE GPPTFEQPKMTIEKLLEYGNMLVQE
                    421                                                             480
```

End of AAA domain

```
      Chlre_RCA (376)                 A    G   AGHGGS  PE YS R-------------------------
      Chlli_RCA (371)           RY MG    AGDHGT    PENYT R-------------------------
      Ostta_RCA (373)           Y   DG V AGSGGSS NTDK I NTK-----------------------
   Glyna_RCA LF (409)                                     KAAQCVKIPVPEGCTDPNASNFDPTA
   Aceru_RCA LF (404)                        D    P S     KAAQCVNVPVPEGCTDRNAANYDPTA
   Aceru_RCA SF (404)                                     --------------------------
   Arath_RCA SF (404)             T    C       GR  T     KTEEKEPSK-----------------
   Chequ_RCA SF (405)                          AS  A     --------------------------
   Desan_RCA SF (395)           TY  C          NT         --------------------------
   Desan_RCA LF (395)           TY  C          NT        KGAQQG-TLPVPEGCTDRDAKNFDPT
   Goshi_RCA SF (407)                     N D   P SA      --------------------------
   Horvu_RCA LF (394)           Y   C          MT         --------------------------
   Lartr_RCA SF (404)                                     --------------------------
   Lycpe_RCA LF (403)             T  SK        NT  IS    KNFTNLKSRLNNEEAKKARHVNFQE---
   Nicta_RCA SF (408)                         A   INN  AS --------------------------
   Orysa_RCA LF (395)           EQ            MT         QGAQQAGNLPVPEGCTDPVAKNFDPT
   Orysa_RCA SF (395)           Q    M  I     N           SAPSS---------------------
   Phavu_RCA SF (408)                    N       S  S    K-------------------------
   Triae_RCA SF (398)             Q    D   MAT  A        K-------------------------
Zanae_RCA SF partial (402)                    MT         K-------------------------
   Zeana_RCA SF (399)                         MT         K-------------------------
 Horvu_RCA SF II (391)                    D    A S       K-------------------------
   Arath_RCA LF (403)             TY    C      GR        KGAHEVNLPVPEGCTDPVAENFDPTA
   Maldo_RCA SF (404)                          MNT        --------------------------
      Anasp_RCA (277) QR DNS  V   NRLNRGRGY APPPE PM QPVNNSSHKRETSNTHLSLETQEQIRQ
      Nossp_RCA (277) QR DNS  V   NRLNRGRGY TAPPPE PV QPVNNSSHKQKTSNTHLSLETQEQIRQ
      Synco_RCA (277) H  EARR      GLRR--S PQ PPPASPF SPPP-VAANSADPAPVSLNPDVQAQLRQ
      Consensus (421) QENVKRVQLAD YLSEAALGDAN DAIK GSF YG
```

Beginning of C-terminal extension

FIGURE 15 (continued)

```
                              481                                                      540
         Chlre_RCA  (409) ------------------------------------------------------------
         Chlli_RCA  (404) ------------------------------------------------------------
         Ostta_RCA  (408) ------------------------------------------------------------
      Glyma_RCA LF  (469) RSDDGTCLYTP-------------------------------------------------
      Aceru_RCA LF  (464) RSDDGSCQYTL-------------------------------------------------
      Aceru_RCA SF  (438) ------------------------------------------------------------
      Arath_RCA SF  (447) ------------------------------------------------------------
      Chequ_RCA SF  (439) ------------------------------------------------------------
      Desan_RCA SF  (429) ------------------------------------------------------------
      Desan_RCA LF  (454) ARSDDGSCLYTF------------------------------------------------
      Goshi_RCA SF  (439) ------------------------------------------------------------
      Horvu_RCA LF  (428) ------------------------------------------------------------
      Lartr_RCA SF  (436) ------------------------------------------------------------
      Lycpe_RCA LF  (460) ------------------------------------------------------------
      Nicta_RCA SF  (443) ------------------------------------------------------------
      Orysa_RCA LF  (455) ARSDDGSCLYTF------------------------------------------------
      Orysa_RCA SF  (434) ------------------------------------------------------------
      Phavu_RCA SF  (442) ------------------------------------------------------------
      Triae_RCA SF  (433) ------------------------------------------------------------
Zanae_RCA SF partial  (436) ----------------------------------------------------------
      Zeama_RCA SF  (433) ------------------------------------------------------------
   Horvu_RCA SF II  (426) ------------------------------------------------------------
      Arath_RCA LF  (463) RSDDGTCVYNF-------------------------------------------------
      Maldo_RCA SF  (438) ------------------------------------------------------------
         Anasp_RCA  (337) ILSQGHKITFEHVDARRFRTGSWQSCGTLHIDAESDAISTLEACLVDYEGEYVRLVGIDP
         Nossp_RCA  (337) ILSQGHKITFEHVDARRFRTGSWQSCGTLHIDAESDAISTLEACLVDYDGEYVRMVGIDP
         Synco_RCA  (334) ILAQGYEILVEHADPRRYRVHSWQECGVAHLREWAAACQAVEQCLSRFPKDYIRLVGVDP
         Consensus  (481)

541              559
         Chlre_RCA  (409) -------------------
         Chlli_RCA  (404) -------------------
         Ostta_RCA  (408) -------------------
      Glyma_RCA LF  (480) -------------------
      Aceru_RCA LF  (475) -------------------
      Aceru_RCA SF  (438) -------------------
      Arath_RCA SF  (447) -------------------
      Chequ_RCA SF  (439) -------------------
      Desan_RCA SF  (429) -------------------
      Desan_RCA LF  (466) -------------------
      Goshi_RCA SF  (439) -------------------
      Horvu_RCA LF  (428) -------------------
      Lartr_RCA SF  (436) -------------------
      Lycpe_RCA LF  (460) -------------------
      Nicta_RCA SF  (443) -------------------
      Orysa_RCA LF  (467) -------------------
      Orysa_RCA SF  (434) -------------------
      Phavu_RCA SF  (442) -------------------
      Triae_RCA SF  (433) -------------------
Zanae_RCA SF partial  (436) -----------------
      Zeama_RCA SF  (433) -------------------
   Horvu_RCA SF II  (426) -------------------
      Arath_RCA LF  (474) -------------------
      Maldo_RCA SF  (438) -------------------
         Anasp_RCA  (397) KGKRRVVETIIQRPNDKN-
         Nossp_RCA  (397) KGKRRVVETIIQRPNGKN-
         Synco_RCA  (394) VKKQRRVEAIIHRP-----
         Consensus  (541)
```

FIGURE 15 (continued)

SEQ ID NO: 250, Chlamydomonas reinhardtii Chlre_RCA nucleic acid sequence AY461703
ATGCAGGTCACCATGAAGAGCAGCGCCGTCAGCGGCCAGCGCGTGGGCGGTGCCCGCGTCGCCACC
CGTAGCGTGCGCCGGGCGCAGCTGCAGGTTGTGGCCTCTAGCCGCAAGCAGATGGGCCGCTGGCGG
TCGATCGACGCGGGCGTCGACGCGTCCGATGACCAGCAAGACATCACTCGCGGCCGCGAGATGGTG
GACGACCTGTTCCAGGGCGGCTTCGGTGCCGGCGGCACCCACAACGCAGTGCTGTCCAGCCAGGAG
TACCTGAGCCAGAGCCGCGCCTCGTTCAACAACATTGAGGACGGCTTCTACATCTCGCCCGCTTTC
CTGGACAAGATGACCATCCACATTGCCAAGAACTTCATGGACCTGCCCAAGATCAAGGTGCCCCTC
ATTCTGGGTATCTGGGGTGGCAAGGGCCAGGGCAAGACCTTCCAGTGCGCGCTCGCCTACAAGAAG
CTGGGCATTGCCCCCATCGTCATGTCCGCTGGTGAGCTGGAGTCCGGCAACGCCGGTGAGCCCGCC
AAGCTGATCCGCACCCGCTACCGGGAGGCCTCCGACATCATCAAGAAGGGCCGCATGTGCTCGCTG
TTCATCAACGATCTGGACGCCGGTGCCGGCCGCATGGGCGACACCACCCAGTACACCGTGAACAAC
CAGATGGTGAACGCCACCCTGATGAACATCGCCGACAACCCGACCAACGTCCAGCTGCCCGGTGTG
TACAAGAACGAGGAGATCCCTCGCGTGCCCATTGTGTGCACGGGCAACGACTTCTCCACCCTGTAC
GCGCCCCTGATCCGCGATGGCCGCATGGAGAAGTACTACTGGAACCCCACCCGCGAGGACCGCATC
GGCGTGTGCATGGGCATCTTCCAGGAGGACAACGTTCAGCGCCGCGAGGTGGAGAACCTGGTGGAC
ACCTTCCCCGGCCAGTCCATTGACTTCTTCGGCGCCCTGCGTGCCCGCGTGTACGACGACATGGTG
CGCCAGTGGATCACCGACACCGGCGTGGACAAGATCGGCCAGCAGCTGGTCAACGCCCGCCAGAAG
GTGGCCATGCCCAAGGTGTCCATGGACCTGAACGTGCTGATCAAGTACGGCAAGTCGCTGGTGGAC
GAGCAGGAGAACGTCAAGCGCGTGCAGCTGGCCGATGCCTACCTGTCGGGCGCCGAGCTGGCCGGC
CACGGCGGCTCTTCCCTGCCCGAGGCCTACAGCCGCTAA

SEQ ID NO: 251, Chlamydomonas reinhardtii Chlre_RCA translated polypeptide sequence
MQVTMKSSAVSGQRVGGARVATRSVRRAQLQVVASSRKQMGRWRSIDAGVDASDDQQDITRGREMV
DDLFQGGFGAGGTHNAVLSSQEYLSQSRASFNNIEDGFYISPAFLDKMTIHIAKNFMDLPKIKVPL
ILGIWGGKGQGKTFQCALAYKKLGIAPIVMSAGELESGNAGEPAKLIRTRYREASDIIKKGRMCSL
FINDLDAGAGRMGDTTQYTVNNQMVNATLMNIADNPTNVQLPGVYKNEEIPRVPIVCTGNDFSTLY
APLIRDGRMEKYYWNPTREDRIGVCMGIFQEDNVQRREVENLVDTFPGQSIDFFGALRARVYDDMV
RQWITDTGVDKIGQQLVNARQKVAMPKVSMDLNVLIKYGKSLVDEQENVKRVQLADAYLSGAELAG
HGGSSLPEAYSR

SEQ ID NO: 252, Chlorococcum littorale Chlli_RCA nucleic acid sequence Y10657
ATGCAGATGCAGATGAAGAACACCGCCTTCAAGGCCACCGGCGCCAAGACTGCTCCCAAGGCCGTC
AGGGTGCCCGCCTGCAAGGCTTCCAAGAGCCAGGCCGGCCGCTGGGCAGCCATCGACGCTGGCAAT
GATATGTCCGACGACCAGCAAGATATCACGCGCGGGCGCGACATGGTTGACTCTCTGTTCCAGGGT
CCTGGCAGCGGTGGTGGCACCCACTCTGCTGTGCTGTCCTCTGAGGACTACCTGTCCACTGCCTCC
CGCAACTTCAACAACGTTGAGGACGGCTTCTACATCTCTCCTGCTTTCCTGGATAAGATGACCATC
CATGTTGCCAAGAACTTCATGGACCTGCCCAAGATCAAGGTTCCCCTCATCCTGGGTATCTGGGGT
GGCAAGGGCCAGGGAAAGACCTTCCAGTGCGCCCTGGCTTACAAGAAGCTGGGCATCAGCCCCATC
GTCATGTCTGCCGGTGAGCTGGAGTCTGGTAACGCCGGTGAGCCCGCCAAGCTCATCCGCCAGCGC
TACCGCGAGGCTTCCGACAGCGTGAAGAAGGGCAAGATGTGCTCCCTCTTCATCAACGATCTGGAC
GCTGGTGCTGGCCGCATGGGCATGGGCACCCAGTACACTGTCAACAACCAGATGGTCAACGCTACC
CTCATGAACATCGCTGATAACCCTACCAACGTGCAGCTGCCCGGCGTGTACAAGGAGGTGCAGATT
CCCCGTGTTCCCATTGTCTGCACGGGTAACGATTTCTCCACCCTGTACGCCCCCCTCATCCGTGAC
GGCCGCATGGAGAAGTACTACTGGAACCCCACCCGTGAGGACCGCATCGGCGTCTGCATGGGAATC

FIGURE 17

```
TTCCAGGAGGACAACGTCAACCGTGGCGAGGTCGAGGTGCTTGTGGATGCCTTCCCCGGGCAGTCG
ATCGACTTCTTCGGTGCCCTCCGCGCCCGCGTCTATGATGACAAGGTCCGTGAATTCGTCAAGAAC
ACTGGTGTCGAGAACCTGTCCAAGCGCCTGATTAACAGCCGCGAGGGCAAGGTTGTCTTCGAGAAG
CCCTCTATGAACCTGGATATCCTGATGAAGTATGGAAAGTTCCTGACCAACGAGCAGGAGAATGTC
AAGCGCGTGCAGCTCGCAGAGGAGTATATGATGGGGGCATCCCTGGCAGGCGACCACGGAACCTCC
CTCCCCGAGAACTACACCCGCTAA
```

SEQ ID NO: 253, Chlorococcum littorale Chlli_RCA Chlli_RCA translated polypeptide sequence

```
MQMQMKNTAFKATGAKTAPKAVRVPACKASKSQAGRWAAIDAGNDMSDDQQDITRGRDMVDSLFQG
PGSGGGTHSAVLSSEDYLSTASRNFNNVEDGFYISPAFLDKMTIHVAKNFMDLPKIKVPLILGIWG
GKGQGKTFQCALAYKKLGISPIVMSAGELESGNAGEPAKLIRQRYREASDSVKKGKMCSLFINDLD
AGAGRMGMGTQYTVNNQMVNATLMNIADNPTNVQLPGVYKEVQIPRVPIVCTGNDFSTLYAPLIRD
GRMEKYYWNPTREDRIGVCMGIFQEDNVNRGEVEVLVDAFPGQSIDFFGALRARVYDDKVREFVKN
TGVENLSKRLINSREGKVVFEKPSMNLDILMKYGKFLTNEQENVKRVQLAEEYMMGASLAGDHGTS
LPENYTR
```

SEQ ID NO: 254, Ostreococcus tauri strain OTTH0595 Ostta_RCA nucleic acid sequence CR954204

```
ATGCGACAGGCTAATGCGACGACGAAGCGCGCCGTCGCGCCGAAGACTTTCTTGGGCGCGCGCGTG
TCCTCCGTCTCCAACGGCTCCAAGGTTGAGATGAGCCGCTGGAAGGGCATGGACATGGACATCTCC
GACGACCAACAAGACATCGCGCGCGGTAAGAACATGGTTGACTCCAAGTTCCAAGGTGGTGCCGGT
ATCGGTGGTACCCACAACGCCGTTATGTCTTCCCAAGACTACTTGTCCGCGGGCATGAAGACGTAC
GACGGTCACGACAACATCACCGCCGAAAACTTCTACATCTCCAAGTCTTACATGGATAAGGTCGTC
GTGCACATCGCGAAGAACTTCATGCAACTCCCGAAGATCAAGGTCCCGCTCATCCTCGGTGTGTGG
GGTGGTAAGGGTCAAGGTAAGACTTTCCAGTCCGACTTGATCTTCCGCAAGCTCGGTATCAACCCG
ATTGTGATGTCCGCTGGTGAGCTCGAATCCGGCAACGCCGGTGAGCCCGCCAAGCTCGTTCGTCAA
CGTTACCGCGAGGCGTCCGACATCGTCAAGAAGGGCCGTATGTCCACGCTCTTCATCAACGATCTC
GATGCCGGTGCCGGTCGTATGGGCGGCACGACGCAGTACACCGTGAACAACCAAATGGTGAACGCG
ACGCTCATGAACATCGCCGACAACCCTACCAACGTCCAGTTGCCGGGCCAATACGAAGTCATCGAG
ATCCCGCGTGTGCCGATCATCGCCACCGGTAACGATTTCTCCACCCTTTACGCGCCGCTCGTTCGT
GACGGCCGTATGGACAAGTTCTACTGGTCCCCGACCTTTGAAGATCGCGTCGGCATTGCCAACGGT
ATCTTCATGGCTGACGGCGTCTCCCCGGAAGACGTCGAAGTCCTTGTCTCCACCTTCGAAGGCCAG
TCCATTGACTTCTTCGGTGCCCTCCGTGCCCGCGTGTACGACGACAAGGTCCGTGACTTCATCCTC
TCTGTTGGCTATGATCAACTCGGCAAGCGCCTCATCAACCCGCGCAAGGGTGAAGAAGTTGTCTTC
GAACCGCCGGCCATGACCCTCGAAGTCCTCTTGGCCTACGGTAAGGAGATCGAAAACGAGCAAGAA
AACATCAAGCGCATCCAATTGGCCGATGCCTACTTGGACGGTGCTGTGTTGGCGGGCTCTGGCGGT
TCCTCGAACACTGACAAGTCTCTCAACACGAAGTAA
```

SEQ ID NO: 255, Ostreococcus tauri strain OTTH0595 Ostta_RCA translated polypeptide sequence

```
MRQANATTKRAVAPKTFLGARVSSVSNGSKVEMSRWKGMDMDISDDQQDIARGKNMVDSKFQGGAG
IGGTHNAVMSSQDYLSAGMKTYDGHDNITAENFYISKSYMDKVVVHIAKNFMQLPKIKVPLILGVW
GGKGQGKTFQSDLIFRKLGINPIVMSAGELESGNAGEPAKLVRQRYREASDIVKKGRMSTLFINDL
DAGAGRMGGTTQYTVNNQMVNATLMNIADNPTNVQLPGQYEVIEIPRVPIIATGNDFSTLYAPLVR
DGRMDKFYWSPTFEDRVGIANGIFMADGVSPEDVEVLVSTFEGQSIDFFGALRARVYDDKVRDFIL
SVGYDQLGKRLINPRKGEEVVFEPPAMTLEVLLAYGKEIENEQENIKRIQLADAYLDGAVLAGSGG
SSNTDKSLNTK
```

FIGURE 17 (continued)

SEQ ID NO: 256, Arabidopsis thaliana Arath_RCA_SF nucleic acid
sequence NM_179989
ATGGCCGCCGCAGTTTCCACCGTCGGTGCCATCAACAGAGCTCCGTTGAGCTTGAACGGGTCAGGA
TCAGGAGCTGTATCAGCCCCAGCTTCAACCTTCTTGGGAAAGAAAGTTGTAACTGTGTCGAGATTC
GCACAGAGCAACAAGAAGAGCAACGGATCATTCAAGGTGTTGGCTGTGAAAGAAGACAAACAAACC
GATGGAGACAGATGGAGAGGTCTTGCCTACGACACTTCTGATGATCAACAAGACATCACCAGAGGC
AAGGGTATGGTTGACTCTGTCTTCCAAGCTCCTATGGGAACCGGAACTCACCACGCTGTCCTTAGC
TCATACGAATACGTTAGCCAAGGCCTTAGGCAGTACAACTTGGACAACATGATGGATGGGTTTTAC
ATTGCTCCTGCTTTCATGGACAAGCTTGTTGTTCACATCACCAAGAACTTCTTGACTCTGCCTAAC
ATCAAGGTTCCACTTATTTTGGGTATATGGGGAGGCAAAGGTCAAGGTAAATCCTTCCAGTGTGAG
CTTGTCATGGCCAAGATGGGTATCAACCCAATCATGATGAGTGCTGGAGAGCTTGAGAGTGGAAAC
GCAGGAGAACCCGCAAAGCTTATCCGTCAGAGGTACCGTGAGGCAGCTGACTTGATCAAGAAGGGA
AAGATGTGTTGTCTCTTCATCAACGATCTTGACGCTGGTGCGGGTCGTATGGGTGGTACTACTCAG
TACACTGTCAACAACCAGATGGTTAACGCAACACTCATGAACATTGCTGATAACCCAACCAACGTC
CAGCTCCCAGGAATGTACAACAAGGAAGAGAACGCACGTGTCCCCATCATTTGCACTGGTAACGAT
TTCTCCACCCTATACGCTCCTCTCATCCGTGATGGACGTATGGAGAAGTTCTACTGGGCCCCGACC
CGTGAAGACCGTATCGGTGTCTGCAAGGGTATCTTCAGAACTGACAAGATCAAGGACGAAGACATT
GTCACACTTGTTGATCAGTTCCCTGGTCAATCTATCGATTTCTTCGGTGCTTTGAGGGCGAGAGTG
TACGATGATGAAGTGAGGAAGTTCGTTGAGAGCCTTGGAGTTGAGAAGATCGGAAAGAGGCTGGTT
AACTCAAGGGAAGGACCTCCCGTGTTCGAGCAACCCGAGATGACTTATGAGAAGCTTATGGAATAC
GGAAACATGCTTGTGATGGAACAAGAGAATGTCAAGAGAGTCCAACTTGCCGAGACCTACCTCAGC
CAGGCTGCTTTGGGAGACGCAAACGCTGACGCCATCGGCCGCGGAACTTTCTACGGTAAAACAGAG
GAAAAGGAGCCCAGCAAGTAA SEQ ID NO: 257, Arabidopsis thaliana Arath_RCA_SF translated
polypeptide sequence
MAAAVSTVGAINRAPLSLNGSGSGAVSAPASTFLGKKVVTVSRFAQSNKKSNGSFKVLAVKEDKQT
DGDRWRGLAYDTSDDQQDITRGKGMVDSVFQAPMGTGTHHAVLSSYEYVSQGLRQYNLDNMMDGFY
IAPAFMDKLVVHITKNFLTLPNIKVPLILGIWGGKGQGKSFQCELVMAKMGINPIMMSAGELESGN
AGEPAKLIRQRYREAADLIKKGKMCCLFINDLDAGAGRMGGTTQYTVNNQMVNATLMNIADNPTNV
QLPGMYNKEENARVPIICTGNDFSTLYAPLIRDGRMEKFYWAPTREDRIGVCKGIFRTDKIKDEDI
VTLVDQFPGQSIDFFGALRARVYDDEVRKFVESLGVEKIGKRLVNSREGPPVFEQPEMTYEKLMEY
GNMLVMEQENVKRVQLAETYLSQAALGDANADAIGRGTFYGKTEEKEPSK SEQ ID NO: 258, Arabidopsis thaliana Arath_RCA_LF nucleic acid
sequence
ATGGCCGCCGCAGTTTCCACCGTCGGTGCCATCAACAGAGCTCCGTTGAGCTTGAACGGGTCAGGA
TCAGGAGCTGTATCAGCCCCAGCTTCAACCTTCTTGGGAAAGAAAGTTGTAACTGTGTCGAGATTC
GCACAGAGCAACAAGAAGAGCAACGGATCATTCAAGGTGTTGGCTGTGAAAGAAGACAAACAAACC
GATGGAGACAGATGGAGAGGTCTTGCCTACGACACTTCTGATGATCAACAAGACATCACCAGAGGC
AAGGGTATGGTTGACTCTGTCTTCCAAGCTCCTATGGGAACCGGAACTCACCACGCTGTCCTTAGC
TCATACGAATACGTTAGCCAAGGCCTTAGGCAGTACAACTTGGACAACATGATGGATGGGTTTTAC
ATTGCTCCTGCTTTCATGGACAAGCTTGTTGTTCACATCACCAAGAACTTCTTGACTCTGCCTAAC
ATCAAGGTTCCACTTATTTTGGGCTCTCGGGGAGGCAAAGGTCAAGGTAAATCCTTCCAGTGTGAG
CTTGTCATGGCCAAGATGGGTATCAACCCAATCATGATGAGTGCTGGAGAGCTTGAGAGTGGAAAC
GCAGGAGAAGTCCGCAAGCTTATCCGTCAGAGGTACCGTGAGGCAGCTGACTTGATCAAGAAGGGA
AAGATGTGTTGTCTCTTCATCAACGATCTTGACGCTGGTGCGGGTCGTATGGGTGGTACTACTCAG FIGURE 17 (continued)

```
TACACTGTCAACAACCAGATGGTTAACGCAACACTCATGAACATTGCTGATAACCCAACCAACGTC
CAGCTCCCAGGAATGTACAACAAGGAAGAGAACGCACGTGTCCCCATCATTTGCACTGGTAACGAT
TTCTCCACCTTATACGGTCCTCTCATCCTTGATGGACGTATGGAGAAGTTCTTGACTGGCCCGACC
CGTGAAGACCGTATCGGTGTCTGGGGTATCTTCAGAACTGACAAGATCAAGGACGAAGACATTGTC
ACACTTGTTGATCAGTTCCCTGGTCAATCTATCGATTTCTTCGGTGCTTTGAGGGCGAGAGTGTAC
GATGATGAAGTGAGGAAGTTCGTTGAGAGCCTTGGAGTTGAGAAGATCGGAAAGAGGCTCGTTAAC
TCAAGGGAAGGACCTCCCGTGTTCGAGCAACCCGAGATGACTTATGAGAAGCTTATGGAATACGGA
AACATGCTTGTGATGGAACAAGAGAATGTCAAGAGAGTCCAACTTGCCGAGACCTACCTCAGCCAG
GCTGCTTTGGGAGACGCAAACGCTGACGCCATCGGCCGCGGAACTTTCTACGGAAAAGGAGCCCAC
GAAGTAAACCTGCCAGTTCCTGAAGGGTGTACTGATCCTGTGGCTGAAAACTTTGATCCAACGGCT
AGAAGTGACGATGGAACCTGTGTCTACAACTTTTGA
```

SEQ ID NO: 259, Arabidopsis thaliana Arath_RCA_LF translated polypeptide sequence
```
MAAAVSTVGAINRAPLSLNGSGSGAVSAPASTFLGKKVVTVSRFAQSNKKSNGSFKVLAVKEDKQT
DGDRWRGLAYDTSDDQQDITRGKGMVDSVFQAPMGTGTHHAVLSSYEYVSQGLRQYNLDNMMDGFY
IAPAFMDKLVVHITKNFLTLPNIKVPLILGSRGGKGQGKSFQCELVMAKMGINPIMMSAGELESGN
AGEVRKLIRQRYREAADLIKKGKMCCLFINDLDAGAGRMGGTTQYTVNNQMVNATLMNIADNPTNV
QLPGMYNKEENARVPIICTGNDFSTLYGPLILDGRMEKFLTGPTREDRIGVWGIFRTDKIKDEDIV
TLVDQFPGQSIDFFGALRARVYDDEVRKFVESLGVEKIGKRLVNSREGPPVFEQPEMTYEKLMEYG
NMLVMEQENVKRVQLAETYLSQAALGDANADAIGRGTFYGKGAHEVNLPVPEGCTDPVAENFDPTA
RSDDGTCVYNF
```

SEQ ID NO: 260, Acer rubrum Aceru_RCA_SF nucleic acid sequence DQ915973
```
ATGGCTGCTGCTGTCTCGACTGTTGGTGCTATCAACAGTGCACCGCTGAGCTTGAATGGCTCTGGT
GCTGCTGGATCCACTGTCCCAACCTCAGCTTTCTTCGGCACAAGCTTGAAGAAGGTGGCCTCAAGA
TTCCCCAACCCGAAGGTCCACTCCGGGAGCTTCAAAGTTGTAGCAGAAATAGACGAGAATAAGCAG
ACCGAAAAGGATAAATGGAGAGGCCTTGCTTATGACACATCCGATGACCAACAAGACATCACCAGA
GGAAAGGGTTTGGTGGACTCTCTCTTCCAGGCCCCCAGCGGGACCGGAACTCACTACGCTGTCATG
AGCTCTTACGACTACATCAGCACTGGTCTTCGAACTTACTTGGAAAACAGCATGGATGGATTTTAC
ATTGCTCCCGCTTTCATGGACAAGCTTGTTGTTCACATCACCAAGAACTTCATGTCTCTGCCTAAC
ATCAAGATTCCTTTGATCTTGGGTATTTGGGGAGGCAAAGGTCAGGGAAAATCATTCCAATGTGAG
CTTGTTTTCGCAAAGATGGGTATTACCCCTATTATGATGAGTGCCGGAGAACTGGAAAGTGGAAAC
GCGGGAGAACCCGCGAAGCTTATCAGGCAAAGATATCGTGAGGCAGCTGATATAATCAAGAAGGGA
AAGATGTGCTGCCTCTTCATCAATGATCTTGATGCCGGAGCTGGACGTATGGGCGGAACCACTCAA
TACACAGTTAACAACCAGATGGTTAATGCTACTCTCATGAACATTGCTGATAATCCAACCAGTGTC
CAGCTCCCTGGAATGTACAACAAGGAGGAAAACCCCGTGTCCCAATCATTGTCACTGGTAACGAC
TTTTCAACCTTGTATGCTCCTCTTATCCGTGATGGTCGTATGGAGAAATTCTACTGGGCTCCTACC
AGGGAAGACCGCATTGGTGTCTGCAAAGGAATTTTCAGGAGTGACAATGTTGCTGATGGTGAACTA
ATCAAGCTTGTCGACACCTTCCCTGGCCAATCAATCGACTTTTTCGGTGCCCTGAGGGCCAGAGTG
TACGACGATGAAGTGAGGAAGTGGATCTCTGGCATAGGCGTTGATAGCATTGGGAAGAACCTTGTG
AACTCAAAGAACGGACCCCCAACCTTCGAGCAACCCAAAATGACAATCGACAAGCTCCTTGAGTAC
GGAAACATGCTTGTCCAGGAGCAAGAGAACGTCAAGAGAGTCCAATTAGCCGACAAGTACCTGAGC
GAGGCTGCCCTTGGCGATGCTAACGATGATGCTATCAAGCGTGGATCTTTCTACGGTTAG
```

FIGURE 17 (continued)

SEQ ID NO: 261, Acer rubrum Aceru_RCA_SF translated polypeptide sequence
MAAAVSTVGAINSAPLSLNGSGAAGSTVPTSAFFGTSLKKVASRFPNPKVHSGSFKVVAEIDENKQ
TEKDKWRGLAYDTSDDQQDITRGKGLVDSLFQAPSGTGTHYAVMSSYDYISTGLRTYLENSMDGFY
IAPAFMDKLVVHITKNFMSLPNIKIPLILGIWGGKGQGKSFQCELVFAKMGITPIMMSAGELESGN
AGEPAKLIRQRYREAADIIKKGKMCCLFINDLDAGAGRMGGTTQYTVNNQMVNATLMNIADNPTSV
QLPGMYNKEENPRVPIIVTGNDFSTLYAPLIRDGRMEKFYWAPTREDRIGVCKGIFRSDNVADGEL
IKLVDTFPGQSIDFFGALRARVYDDEVRKWISGIGVDSIGKNLVNSKNGPPTFEQPKMTIDKLLEY
GNMLVQEQENVKRVQLADKYLSEAALGDANDDAIKRGSFYG

SEQ ID NO: 262, Acer rubrum Aceru_RCA_LF nucleic acid sequence DQ915974
ATGGCTGCTGCTGTCTCGACTGTTGGTGCTATCAACAGTGCACCGCTGAGCTTGAATGGCTCTGGT
GCTGCTGGATCCACTGTCCCAACCTCAGCTTTCTTCGGCACAAGCTTGAAGAAGGTGGCCTCAAGA
TTCCCCAACCCGAAGGTCCACTCCGGGAGCTTCAAAGTTGTAGCAGAAATAGACGAGAATAAGCAG
ACCGAAAAGGATAAATGGAGAGGCCTTGCTTATGACACATCCGATGACCAACAAGACATCACCAGA
GGAAAGGGTTTGGTGGACTCTCTCTTCCAGGCCCCCAGCGGGACCGGAACTCACTACGCTGTCATG
AGCTCTTACGACTACATCAGCACTGGTCTTCGAACTTACTTGGAAAACAGCATGGATGGATTTTAC
ATTGCTCCCGCTTTCATGGACAAGCTTGTTGTTCACATCACCAAGAACTTCATGTCTCTGCCTAAC
ATCAAGATTCCTTTGATCTTGGGTATTTGGGGAGGCAAAGGTCAGGGAAAATCATTCCAATGTGAG
CTTGTTTTCGCAAAGATGGGTATTACCCCTATTATGATGAGTGCCGGAGAACTGGAAAGTGGAAAC
GCGGGAGAACCCGCGAAGCTTATCAGGCAAAGATATCGTGAGGCAGCTGATATAATCAAGAAGGGA
AAGATGTGCTGCCTCTTCATCAATGATCTTGATGCCGGAGCTGGACGTATGGGCGGAACCACTCAA
TACACAGTTAACAACCAGATGGTTAATGCTACTCTCATGAACATTGCTGATAATCCAACCAGTGTC
CAGCTCCCTGGAATGTACAACAAGGAGGAAAACCCCGTGTCCCAATCATTGTCACTGGTAACGAC
TTTTCAACCTTGTATGCTCCTCTTATCCGTGATGGTCGTATGGAGAAATTCTACTGGGCTCCTACC
AGGGAAGACCGCATTGGTGTCTGCAAAGGAATTTTCAGGAGTGACAATGTTGCTGATGGTGAACTA
ATCAAGCTTGTCGACACCTTCCCTGGCCAATCAATCGACTTTTTCGGTGCCCTGAGGGCCAGAGTG
TACGACGATGAAGTGAGGAAGTGGATCTCTGGCATAGGCGTTGATAGCATTGGGAAGAACCTTGTG
AACTCAAAGAACGGACCCCCAACCTTCGAGCAACCCAAAATGACAATCGACAAGCTCCTTGAGTAC
GGAAACATGCTTGTCCAGGAGCAAGAGAACGTCAAGAGAGTCCAATTAGCCGACAAGTACCTGAGC
GAGGCTGCCCTTGGCGATGCTAACGATGATGCTATCAAGCGTGGATCTTTCTACGGCAAAGCAGCT
CAGCAAGTGAATGTTCCTGTCCCTGAAGGTTGTACTGATCGAAATGCAGCAAACTATGATCCAACG
GCAAGGAGTGATGACGGAAGCTGCCAGTATACACTCTAG

SEQ ID NO: 263, Acer rubrum Aceru_RCA_LF translated polypeptide sequence
MAAAVSTVGAINSAPLSLNGSGAAGSTVPTSAFFGTSLKKVASRFPNPKVHSGSFKVVAEIDENKQ
TEKDKWRGLAYDTSDDQQDITRGKGLVDSLFQAPSGTGTHYAVMSSYDYISTGLRTYLENSMDGFY
IAPAFMDKLVVHITKNFMSLPNIKIPLILGIWGGKGQGKSFQCELVFAKMGITPIMMSAGELESGN
AGEPAKLIRQRYREAADIIKKGKMCCLFINDLDAGAGRMGGTTQYTVNNQMVNATLMNIADNPTSV
QLPGMYNKEENPRVPIIVTGNDFSTLYAPLIRDGRMEKFYWAPTREDRIGVCKGIFRSDNVADGEL
IKLVDTFPGQSIDFFGALRARVYDDEVRKWISGIGVDSIGKNLVNSKNGPPTFEQPKMTIDKLLEY
GNMLVQEQENVKRVQLADKYLSEAALGDANDDAIKRGSFYGKAAQQVNVPVPEGCTDRNAANYDPT
ARSDDGSCQYTL

FIGURE 17 (continued)

SEQ ID NO: 264, Chenopodium quinoa Chequ_RCA SF nucleic acid sequence AY117142
ATGGCTACTGCTGTCTCAACCGTCGGAGCTGCTACCAAGGCACCTTTGAACTTGAATGGCTCGAGC
GCTGGGGCATCAGTCCCAACCTCAGCTTTCTTAGGGAGCAGCTTAAAGAAGCATACAAGTGTGAGA
TTCCCAAGCAGCTCTAGGGCGAGCTCAATGACCGTCAAGGCGGCTGACTACGAGGAGAGCAAGCAG
TCCAACACGGACAGATGGGCTCATTTGGCTACAGACATCTCTGATGATCAACTCGACATCCGTAGG
GGTAAGGGTATGGTTGACTCCCTCTTCCAAGCTCCGATGGACTCCGGCACCCACGTTCCAGTTCAG
AGTTCACTCGAATACGAGAGTCAAGGTCTTAGGAAGTACAACATCGACAACATGTTGGGTAACTTC
TACATTGCCCCTTCTTTCATGGACAAGATTGTTGTTCACATCACCAAGAACTACTTGAACTTGCCT
AACATCAAGGTTCCCCTGATCTTGGGTATTTGGGGAGGCAAAGGTCAAGGTAAATCCTTCCAATGT
GAGCTTGTGTTCGCCAAGATGGGAATCAACCCCATCATGATGAGTGCGGGAGAATTGGAAAGTGGA
AACGCAGGAGAGCCAGCAAAGTTGATCAGGCAAAGGTACCGTGAGGCAGCAGACATAATTGCCAAG
GGAAAGATGTGTGCTCTGTTCATCAACGATCTCGACGCGGGTGCTGGACGTATGGGAGGCACCACA
CAATACACCGTGAACAACCAGATGGTTAACGCCACCCTCATGAACATTGCTGACAACCCCACCAAT
GTCCAACTCCCTGGTATGTACAACAAGCAAGAGAACGCCCGTGTTCCCATTATCGTCACTGGTAAC
GACTTCTCCACCTTGTACGCTCCCCTTATCCGTGATGGTCGTATGGAGAAGTTCTACTGGGCTCCC
ACCCGTGAGGACCGTATCGGTGTTGCCACCGGTATCTTCAGGACCGACAATGTTCCTGAGGACCAC
GTTGTCAAGCTCGTCGACACCTTCCCTGGCCAATCTATTGATTTCTTCGGTGCCTTGAGGGCTCGT
GTATACGATGATGAAGTAAGGAAGTGGGTTTCTGAAGTAGGAATTGACGCCGTAGGAAAGAAGCTC
GTAAACTCAAGGGACGGACCACCAGTGTTCGAACAACCAAAAATGACCTTGGAAAAGTTGCTTGAA
TACGGAAACATGCTTGTGCAAGAGCAAGAGAATGTCAAGAGAGTCCAACTTGCTGACAAGTACTTG
AGCGAGGCTGCTCTTGGAGATGCTAACAAAGATGCTATTGCATCCGGAGCTTTCTTCGGTTAA SEQ ID NO: 265, Chenopodium quinoa Chequ_RCA SF translated polypeptide sequence
MATAVSTVGAATKAPLNLNGSSAGASVPTSAFLGSSLKKHTSVRFPSSSRASSMTVKAADYEESKQ
SNTDRWAHLATDISDDQLDIRRGKGMVDSLFQAPMDSGTHVPVQSSLEYESQGLRKYNIDNMLGNF
YIAPSFMDKIVVHITKNYLNLPNIKVPLILGIWGGKGQGKSFQCELVFAKMGINPIMMSAGELESG
NAGEPAKLIRQRYREAADIIAKGKMCALFINDLDAGAGRMGGTTQYTVNNQMVNATLMNIADNPTN
VQLPGMYNKQENARVPIIVTGNDFSTLYAPLIRDGRMEKFYWAPTREDRIGVATGIFRTDNVPEDH
VVKLVDTFPGQSIDFFGALRARVYDDEVRKWVSEVGIDAVGKKLVNSRDGPPVFEQPKMTLEKLLE
YGNMLVQEQENVKRVQLADKYLSEAALGDANKDAIASGAFFG SEQ ID NO: 266, Deschampsia antartica Desan_RCA SF nucleic acid sequence AY312574
ATGGCTGCTGCCTTCTCCTCCACCGTCGGAGCTCCGGCTTCCACGCCNACCAGCTTCCTCGGCAAC
AAGCTCAAGAAGCAGGTGACCTCGGCAGTGAACTACCATGGCAAGAGCTTCAAGGCCAACAGGTTC
ACCGTCATGGCCAAGGATATCGACGAGGGCAAGCAGACCGACGGGGACAAGTGGAAGGGCCTCGCC
TACGATATCTCCGACGACCAGCAGGACATCACCAGGGGTAAGGGTATCGTCGACTCCTTGTTCCAG
GCGCCCATGGGCGATGGNACCCACGAGGCCGTCCTCAGCTCNTACGAGTACGTCAGCCAGGGCCTC
AAGAAGTACGACTTCGACAACACCATGGGAGGCTTCTACATCGCCCCGGCTTTCATGGACAAGCTC
GTTGTCCACCTCTCCAAGAACTTCATGACCCTGCCCAACATCAAGATCCCACTCATCTTGGGTATC
TGGGGAGGAAAGGGTCAGGGGAAATCCTTCCAGTGTGAGCTTGTCTTCGCCAAGATGGGCATCAAC
CCAATCATGATGAGTGCCGGAGAGCTGGAGAGCGGCAACGCCGGAGAGCCAGCCAAGCTCATCAGG
CAGCGGTACCGCGAGGCCGCAGACATGATCAAGAAGGGCAAGATGTGCTGCCTCTTCATCAACGAC
CTCGACGCCGGCGCGGGTCGGATGGGCGGGACCACCCAGTACACCGTGAACAACCAGATGGTGAAC
GCCACCCTGATGAACATCGCCGACGCGCCCACCAACGTGCAGCTCCCGGGGATGTACAACAAGGAG FIGURE 17 (continued)

```
GAGAACCCCCGTGTCCCCATCATCGTCACCGGCAACGACTTCTCGACGCTGTACGCGCCCCTCATC
CGTGACGGTCGTATGGAGAAGTTCTACTGGGCGCCCACCCGCGAGGACCGTATCGGCGTCTGCAAG
GGTATCTTCCAGACCGACAACGTCAGCGACGAGTCTGTCGTCAAGATCGTCGACACNTTCCCAGGA
CAGTCCATCGACTTCTTCGGTGCTCTGCGTGCTCGGGTGTACGACGTTGAGGTGCGCAAGTGGGTG
TCGTCCACCGGAATTGAGAACATCGGCAAGAGGCTGGTGAACTCGCGGGACGGACCCGTCACCTTC
GAGCAGCCCAAGATGACGGTGGAGAAGTTGCTGGAGTACGGCCACATGCTTGTCCAGGAGCAGGAC
AATGTCAAGCGTGTGCAGCTTGCGGACACTTACATGAGCCAGGCAGCTCTGGGTGATGCGAACAAG
GATGCCATGAAGACTGGTTCCTTCTACGGTTAG
```

SEQ ID NO: 267, Deschampsia antartica Desan_RCA SF translated polypeptide sequence
```
MAAAFSSTVGAPASTPTSFLGNKLKKQVTSAVNYHGKSFKANRFTVMAKDIDEGKQTDGDKWKGLA
YDISDDQQDITRGKGIVDSLFQAPMGDGTHEAVLSSYEYVSQGLKKYDFDNTMGGFYIAPAFMDKL
VVHLSKNFMTLPNIKIPLILGIWGGKGQGKSFQCELVFAKMGINPIMMSAGELESGNAGEPAKLIR
QRYREAADMIKKGKMCCLFINDLDAGAGRMGGTTQYTVNNQMVNATLMNIADAPTNVQLPGMYNKE
ENPRVPIIVTGNDFSTLYAPLIRDGRMEKFYWAPTREDRIGVCKGIFQTDNVSDESVVKIVDTFPG
QSIDFFGALRARVYDVEVRKWVSSTGIENIGKRLVNSRDGPVTFEQPKMTVEKLLEYGHMLVQEQD
NVKRVQLADTYMSQAALGDANKDAMKTGSFYG
```

SEQ ID NO: 268, Deschampsia antartica Desan_RCA LF nucleic acid sequence AY312573
```
ATGGCTGCTGCCTTCTCCTCCACCGTCGGAGCTCCGGCTTCCACGCCGACCAGCTTCCTCGGCAAC
AAGCTCAAGAAGCAGGTGACCTCGGCAGTGAACTACCATGGCAAGAGCTTCAAGGCCAACAGGTTC
ACCGTCATGGCCAAGGATATCGACGAGGGCAAGCAGACCGACGGGGACAAGTGGAAGGGCCTCGCC
TACGATATCTCCGACGACCAGCAGGACATCACCAGGGGTAAGGGTATCGTCGACTCCCTGTTCCAG
GCGCCCATGGGCGATGGCACCCACGAGGCCGTCCTCAGCTCCTACGAGTACGTCAGCCAGGGCCTC
AAGAAGTACGACTTCGACAACACCATGGGAGGCTTCTACATCGCCCCGGCTTTCATGGACAAGCTC
GTTGTCCACCTCTCCAAGAACTTCATGACCCTGCCCAACATCAAGATCCCACTCATCTTGGGTATC
TGGGGAGGAAAGGGTCAGGGGAAATCCTTCCAGTGTGAGCTTGTCTTCGCCAAGATGGGCATCAAC
CCAATCATGATGAGTGCCGGAGAGCTGGAGAGCGGCAACGCCGGAGAGCCAGCCAAGCTCATCAGG
CAGCGGTACCGCGAGGCCGCAGACATGATCAAGAAGGGCAAGATGTGCTGCCTCTTCATCAACGAC
CTCGACGCCGGCGCGGGTCGGATGGGCGGGACCACCCAGTACACCGTGAACAACCAGATGGTGAAC
GCCACCCTGATGAACATCGCCGACGCGCCCACCAACGTGCAGCTTCCGGGGATGTACAACAAGGAG
GAGAACCCCCGTGTTCCCATTATNGTCACCGGCAACGACTTTTCGACGCTGTACGCCCCCCTTATT
CCTGACGGTCGTATGGAGAAGTTTTACTGGGCGCCCACCCGCGAGGACCGTATCGGCGTCTGCAAG
GGTATCTTCCAGACCGACAACGTCAGCGACGAGTCTGTCGTCAAGATCGTCGACACCTTCCCAGGA
CAGTCCATCGACTTCTTCGGTGCTCTGCGTGCTCGGGTGTACGACGACGAGGTGCGCAAGTGGGTG
TCGTCCACCGGAATTGAGAACATCGGCAAGAGGCTGGTGAACTCGCGGGACGGACCCGTCACCTTC
GAGCAGCCCAAGATGACGGTGGAGAAGTTGCTGGAGTACGGCCACATGCTTGTCCAGGAGCAGGAC
AATGTCAAGCGTGTGCAGCTTGCGGACACTTACATGAGCCAGGCAGCTCTGGGTGATGCGAACAAG
GATGCCATGAAGACTGGTTCCTTCTACGGTAAAGGAGCACAACAAGGCACTTTGCCTGTGCCGGAA
GGTTGTACCGACCGGGATGCCAAGAACTTCGACCCAACCGCGAGGAGCGACGACGGCAGCTGCCTT
TACACCTTTTAA
```

FIGURE 17 (continued)

SEQ ID NO: 269, Deschampsia antartica Desan_RCA_LF translated polypeptide sequence
MAAAFSSTVGAPASTPTSFLGNKLKKQVTSAVNYHGKSFKANRFTVMAKDIDEGKQTDGDKWKGLA
YDISDDQQDITRGKGIVDSLFQAPMGDGTHEAVLSSYEYVSQGLKKYDFDNTMGGFYIAPAFMDKL
VVHLSKNFMTLPNIKIPLILGIWGGKGQGKSFQCELVFAKMGINPIMMSAGELESGNAGEPAKLIR
QRYREAADMIKKGKMCCLFINDLDAGAGRMGGTTQYTVNNQMVNATLMNIADAPTNVQLPGMYNKE
ENPRVPIXVTGNDFSTLYAPLIPDGRMEKFYWAPTREDRIGVCKGIFQTDNVSDESVVKIVDTFPG
QSIDFFGALRARVYDDEVRKWVSSTGIENIGKRLVNSRDGPVTFEQPKMTVEKLLEYGHMLVQEQD
NVKRVQLADTYMSQAALGDANKDAMKTGSFYGKGAQQGTLPVPEGCTDRDAKNFDPTARSDDGSCL
YTF SEQ ID NO: 270, Glycine max Glyma_RCA_LF nucleic acid sequence
ATGGCTGCCTCCGTCTCCACTGTCGGAGCTGTCAACAGAGCTCTTTTGAACCTGAATGGTTCTGGA
GCTGGAGCTTCAGCTCCCAGTTCAGCCTTCTTTGGGACCAGCTTGAAGAAGGTTATTGCCTCAAGG
GTCCCCAACAGCAAGGTTTCCGGTGGAAGCTTCAAGATTGTTGCTGTAGAAGAGAAGAAAGAGATT
GAAGAGACCCAGCAGACCGACAAGGACAGATGGAAGGGTCTTGCCTATGATATCTCAGACGACCAA
CAAGACATCACAAGAGGAAAGGGTTTGGTTGACTCCCTTTTCCAAGCTCCACAGGATGCTGGAACT
CACTATGCAGTCATGAGCTCCTACGAGTACCTTAGCACTGGACTTCGCCAGTACTTGGACAACAAC
ATGGATGGATTTTACATTGCTCCAGCTTTTATGGACAAGCTTGTTGTTCACATCAGCAAGAACTTC
ATGACCCTGCCCAACATCAAGGTTCCTCTCATTCTTGGTATCTGGGGAGGCAAAGGTCAAGGAAAA
TCTTTCCAATGCGAGCTTGTCTTTGCCAAGATGGGAATCAACCCCATCATGATGAGTGCTGGAGAG
TTGGAAAGTGGAAATGCAGGAGAGCCAGCAAAACTGATCAGACAGAGATACCGTGAAGCCGCAGAC
ATGATCAAGAAGGGAAAGATGTGTGCTCTCTTCATCAACGATCTTGATGCAGGAGCTGGTCGTCTT
GGTGGAACTACACAATACACTGTCAACAACCAGATGGTGAATGCCACCCTCATGAACATTGCTGAT
AACCCCACCAATGTGCAGCTTCCTGGTATGTACAACAAGGAAGAGAACCCCGTGTGCCCATCATC
GTCACCGGTAACGATTTCTCAACACTGTATGCTCCTCTCATCCGTGATGGGCGTATGGAGAAGTTC
TACTGGGCACCTACAAGGGACGATCGTGTTGGCGTCTGCAATGGAATTTTCCGCACTGACAATGTT
CCTAAGGATGACATTGTCAAGCTTGTTGACACCTTCCCCGGCCAATCTATTGATTTCTTTGGTGCA
CTCAGGGCTAGAGTATATGATGATGAGGTGAGGAAGTGGATTTCTGTTGTTGGTGTTGACTTCATT
GGGAAGAAGCTTGTGAACTCCAAGGAAGGACCTCCAACCTTTGACCAACCGAAGATGACTTTGAGC
AAGCTCTTGGAGTATGGTAACATGCTTGTCCAAGAACAAGAGAATGTGAAGAGAGTACAACTGGCA
GACAAGTACTTGAAAGAGGCTGCTCTTGGTGATGCTAATCAAGATGCCATCAAAAGAGGAACTTTC
TATGGCAAAGCAGCCCAGCAAGTAAAAATTCCCGTTCCTGAAGGTTGTACTGATCCAAATGCCTCA
AACTTCGACCCAACTGCAAGAAGTGATGATGGAACCTGCTTATACACACCCTGA SEQ ID NO: 271, Glycine max Glyma_RCA_LF translated polypeptide sequence
MAASVSTVGAVNRALLNLNGSGAGASAPSSAFFGTSLKKVIASRVPNSKVSGGSFKIVAVEEKKEI
EETQQTDKDRWKGLAYDISDDQQDITRGKGLVDSLFQAPQDAGTHYAVMSSYEYLSTGLRQYLDNN
MDGFYIAPAFMDKLVVHISKNFMTLPNIKVPLILGIWGGKGQGKSFQCELVFAKMGINPIMMSAGE
LESGNAGEPAKLIRQRYREAADMIKKGKMCALFINDLDAGAGRLGGTTQYTVNNQMVNATLMNIAD
NPTNVQLPGMYNKEENPRVPIIVTGNDFSTLYAPLIRDGRMEKFYWAPTRDDRVGVCNGIFRTDNV
PKDDIVKLVDTFPGQSIDFFGALRARVYDDEVRKWISVVGVDFIGKKLVNSKEGPPTFDQPKMTLS
KLLEYGNMLVQEQENVKRVQLADKYLKEAALGDANQDAIKRGTFYGKAAQQVKIPVPEGCTDPNAS
NFDPTARSDDGTCLYTP FIGURE 17 (continued)

SEQ ID NO: 272, Gossypium hirsutum Goshi_RCA SF nucleic acid sequence AF329934
ATGGCGGCTGCCGTCTCCACCATCGGTGCTGTCAACCGAGCACCGTTGAGTTTGAATGGATCAGGT
GCCGGAGCTTCTGCTCCAAGCTCAGCTTTCATGGGGAACAGCTTGAAGAAAGTGAGCGCTAGGTTC
AACAACAACGGCAAGGCTCCAGTGGGAAGTTTCAAGATTGTGGCTGCCAAAGAAATCGACGAAGAC
ACACAGACCGACCAGGACCGATGGAAGGGTCTTGCTTATGATATCTCCGATGACCAACAAGACATT
ACCAGAGGGAAAGGTATGGTCGACTCATTGTTCCAAGCTCCCATGAACGATGGTACTCACTATGCT
GTCATGAGCTCCTATGAGTACATTAGCCAAGGCCTTCGCACATACGACTTGGACAACAACATGGAT
GGATTCTACATTGCCCCAGCTTTCATGGACAAGCTTGTTGTTCACATCACCAAGAACTACATGACC
CTTCCTAACATTAAGGTTCCTCTTATCTTGGGTATTTGGGGAGGCAAAGGTCAAGGAAAATCTTTC
CAATGTGAGCTTGTCTTTGCCAAGATGGGAATCAACCCCATTATGATGAGTGCCGGAGAATTGGAA
AGTGGGAACGCCGGAGAACCAGCCAAGTTGATCAGGCAAAGGTACCGTGAGGCCGCCGACATTATC
AAGAAAGGGAAAATGTGTTGCCTCTTTATCAACGATCTCGACGCTGGAGCCGGTCGTATGGGAGGA
ACCACACAATACACAGTGAACAACCAAATGGTGAACGCCACACTCATGAACATCGCTGATAACCCC
ACCAACGTTCAGCTCCCCGGTATGTACAACAAGGAAGAGAACCCTCGTGTTCCGATCATTGTCACC
GGTAACGATTTCTCGACGCTGTACGCGCCGCTCATCCGTGACGGTCGTATGGAGAAGTTTTACTGG
GCACCCACCAGGGAAGATAGGATCGGTGTTTGCACAGGTATTTTCAGGACCGACAATGTTCCCGTT
GATGACATTGTTAAGCTTGTTGACACCTTCCCGGGCCAATCCATTGACTTTTTCGGTGCTCTGAGG
GCCAGAGTTTACGATGACGAAGTGAGGAAATGGATCGGAGAGGTAGGAGTCAATAGTGTCGGGAAA
AAGCTCGTGAACTCGAGGGAAGGGCCACCATCTTTCGAGCAACCTACGATGACCATTGAGAAGCTG
TTGGAGTATGGAAACATGCTTGTTGCTGAACAAGAGAACGTGAAGAGGGTTCAATTGGCTGACAAA
TATTTGAGTGAAGCTGCCCTTGGAAATGCTAATGACGATGCTATCAAGAGAGGAGCTTTCTAA

SEQ ID NO: 273, Gossypium hirsutum Goshi_RCA SF translated polypeptide sequence
MAAAVSTIGAVNRAPLSLNGSGAGASAPSSAFMGNSLKKVSARFNNNGKAPVGSFKIVAAKEIDED
TQTDQDRWKGLAYDISDDQQDITRGKGMVDSLFQAPMNDGTHYAVMSSYEYISQGLRTYDLDNNMD
GFYIAPAFMDKLVVHITKNYMTLPNIKVPLILGIWGGKGQGKSFQCELVFAKMGINPIMMSAGELE
SGNAGEPAKLIRQRYREAADIIKKGKMCCLFINDLDAGAGRMGGTTQYTVNNQMVNATLMNIADNP
TNVQLPGMYNKEENPRVPIIVTGNDFSTLYAPLIRDGRMEKFYWAPTREDRIGVCTGIFRTDNVPV
DDIVKLVDTFPGQSIDFFGALRARVYDDEVRKWIGEVGVNSVGKKLVNSREGPPSFEQPTMTIEKL
LEYGNMLVAEQENVKRVQLADKYLSEAALGNANDDAIKRGAF

SEQ ID NO: 274, Hordeum vulgare Horvu_RCA SF nucleic acid sequence M55447.1
ATGGCTGCTGCCTTCTCCTCCACCGTCGGGGCTCCGGCTTCTACGCCGACCAACTTCCTCGGGAAG
AAGCTCAAGAAGCAGGTGACCTCGGCCGTGAACTACCATGGCAAGAGCTCCAAGGCCAACAGGTTC
ACAGTCATGGCAGCGGAGAACATCGACGAGAAGAGGAACACCGACAAGTGGAAGGGTCTTGCTACC
GATATCTCCGACGACCAGCAGGACATCACCAGAGGGAAGGGCATCGTGGACTCGCTCTTCCAGGCG
CCCACGGGCGACGGCACCCACGAGGCCGTCCTCAGCTCCTACGAGTACGTCAGCCAGGGCCTGCGG
AAGTACGACTTCGACAACACCATGGAGGCTTCTACATCGCTCCTGCTTTCATGGACAAGCTTGTT
GTCCATCTCTCCAAAAACTTCATGACCCTGCCCAACATCAAGATCCCACTCATCTTGGGTATCTGG
GGAGGCAAGGGTCAAGGAAAATCATTCCAGTGTGAGCTTGTGTTCGCCAAGATGGGCATCAACCCC
ATCATGATGAGTGCCGGAGAGCTGGAGAGTGGGAACGCTGGAGAGCCAGCCAAGCTCATCAGGCAG
CGGTACCGTGAGGCTGCAGACATGATCAAGAAGGGTAAGATGTGCTGCCTCTTCATCAACGATCTT
GACGCTGGTGCGGGTAGGATGGGCGGAACCACGCAGTACACCGTCAACAACCAGATGGTGAACGCC
ACCCTGATGAACATCGCCGATGCCCCCACCAACGTGCAGCTCCCTGGCATGTACAACAAGAGGGAG

```
AACCCCCGTGTGCCCATCGTCGTCACCGGTAACGATTTCTCGACGCTCTACGCTCCTCTGATCCGT
GATGGTCGTATGGAGAAGTTCTACTGGGCTCCCACCCGTGACGACCGTATCGGTGTCTGCAAGGGT
ATCTTCCAGACCGACAATGTCTGTGACGAGTCTGTCGTAAAGATCGTCGACACCTTCCCAGGACAA
TCCATTGACTTTTTCGGTGCTCTGCGTGCTCGGGTGTACGACGATGAGGTGCGCAAGTGGGTCGGC
TCTACCGGAATCGAGAACATTGGCAAGAGGCTGGTGAACTCGCGGGACGGGCCCGTGACCTTCGAG
CAGCCAAAGATGACAGTCGAGAAGCTGCTAGAGTACGGGCACATGCTCGTCCAGGAGCAGGACAAT
GTCAAGCGTGTGCAGCTTGCTGACACCTACATGAGCCAGGCAGCTCTGGGTGATGCTAACCAGGAT
GCGATGAAGACTGGTTCCTTCTACGGTTAG
```

SEQ ID NO: 275, Hordeum vulgare Horvu_RCA SF translated polypeptide sequence
```
MAAAFSSTVGAPASTPTNFLGKKLKKQVTSAVNYHGKSSKANRFTVMAAENIDEKRNTDKWKGLAT
DISDDQQDITRGKGIVDSLFQAPTGDGTHEAVLSSYEYVSQGLRKYDFDNTMGGFYIAPAFMDKLV
VHLSKNFMTLPNIKIPLILGIWGGKGQGKSFQCELVFAKMGINPIMMSAGELESGNAGEPAKLIRQ
RYREAADMIKKGKMCCLFINDLDAGAGRMGGTTQYTVNNQMVNATLMNIADAPTNVQLPGMYNKRE
NPRVPIVVTGNDFSTLYAPLIRDGRMEKFYWAPTRDDRIGVCKGIFQTDNVCDESVVKIVDTFPGQ
SIDFFGALRARVYDDEVRKWVGSTGIENIGKRLVNSRDGPVTFEQPKMTVEKLLEYGHMLVQEQDN
VKRVQLADTYMSQAALGDANQDAMKTGSFYG
```

SEQ ID NO: 276, Hordeum vulgare Horvu_RCA SFII nucleic acid sequence M55448.1
```
ATGGCTTCTGCTTTCTCGTCCACCGTTGGAGCTCCGGCGTCGACCCCGACCATCTTCCTGGGCAAG
AAGGTGAAGAACTACTACCATGGTGGCAACAAGATGAAGAGCAGGGTGGTGAGGGTCATGGCGGCC
AAAAAGGAACTTGACCAGGGCAAGCAGACCGATGCGGACCGGTGGAAGGGTCTGGCCTACGACATC
TCGGACGACCAGCAGGACATCACTCGGGGGAAAGGCATCGTGGACTCCCTGTTCCAGGCCCCCATG
GGCGACGGCACCCACGAGGCCATCCTAAGCTCCTACGAGTACATCAGCCAGGGCCTGCGGAAGTAC
GACTTCGACAACACCATGGACGGGCTGTACATCGCGCCGGCATTCATGGACAAGCTCATCGTCCAC
CTCGCCAAGAACTTCATGACACTCCCCAACATCAAGGTTCCTCTCATCCTGGGTATCTGGGGAGGC
AAGGGACAGGGCAAGTCGTTCCAGTGTGAGCTGGTGTTCGCCAAGATGGGCATCAACCCCATCATG
ATGAGCGCCGGTGAGCTGGAGAGCGGCAACGGCGAGCCGGCCAAGCTGATCCGGCAGAGGTACCGC
GAGGCGGCCGACATTATCAACAAGGGCAAGATGTGCTGCCTCTTCATCAACGACCTGGACGCCGGC
GCGGGCCGGATGGGCGGGACGACGCAGTACACGGTGAACAACCAGATGGTGAACGCCACCCTGATG
AACATCGCGGACGCGCCCACCAACGTGCAGCTCCCGGGGATGTACAACAAGGAGGAGAACCCCCGC
GTGCCCATCATCGTCACCGGCAACGACTTCTCGACGCTGTACGCTCCCCTGATCCGTGACGGGCGC
ATGGAGAAGTTCTACTGGGCGCCCACCCGCGAGGACCGCATCGGCGTGTGCAAGGGCATCTTCCGC
ACCGACAACGTCCCGGACGAGGCCGTGGTGAGGCTGGTGGACACCTTCCCGGGGCAGTCCATCGAC
TTCTTCGGCGCGCTGCGGGCACGGGTGTACGACGACGAGGTGCGCAAGTGGGTCGGCGAGATCGGC
GTGGAGAACATCTCCAAGCGCCTCGTCAACTCCAGGGAGGGGCCGCCCACGTTCGACCAGCCCAAG
ATGACCATAGAGAAGCTCATGGAGTACGGCCACATGCTGGTCCAGGAGCAGGAGAACGTCAAGCGT
GTGCAGCTCGCCGACAAGTACCTCAGCGAGGCGGCGCTCGGCCAAGCCAACGACGACGCCATGAAG
ACCGGTGCCTTCTACGGCAAGTAG
```

SEQ ID NO: 277, Hordeum vulgare Horvu_RCA SFII translated polypeptide sequence
```
MASAFSSTVGAPASTPTIFLGKKVKNYYHGGNKMKSRVVRVMAAKKELDQGKQTDADRWKGLAYDI
SDDQQDITRGKGIVDSLFQAPMGDGTHEAILSSYEYISQGLRKYDFDNTMDGLYIAPAFMDKLIVH
LAKNFMTLPNIKVPLILGIWGGKGQGKSFQCELVFAKMGINPIMMSAGELESGNGEPAKLIRQRYR
```

FIGURE 17 (continued)

EAADIINKGKMCCLFINDLDAGAGRMGGTTQYTVNNQMVNATLMNIADAPTNVQLPGMYNKEENPR
VPIIVTGNDFSTLYAPLIRDGRMEKFYWAPTREDRIGVCKGIFRTDNVPDEAVVRLVDTFPGQSID
FFGALRARVYDDEVRKWVGEIGVENISKRLVNSREGPPTFDQPKMTIEKLMEYGHMLVQEQENVKR
VQLADKYLSEAALGQANDDAMKTGAFYGK

SEQ ID NO: 278, Larrea tridentata Lartr_RCA SF nucleic acid sequence AY312576
ATGGCTGCTGCCTACTCCACCGTCGGAGCTGTCAACAGGGCACCGCTGAGCTTGAATGGNTCTGGT
GCGAGAGCTTCATTGGTTCCAAGCACTGCCTTCTTCGGCAGCAGCTTGAAGAAATCTGCTGCGAAA
TTCCCCAAGGCGTCATCAGGAAACTTCAAGATTGTTGCACAAGAAATTAGTGAGGATCAGCAGACC
GACAAGGACAAATGGAAGGGTCTTGCCTATGACATTTCTGATGATCAACAGGATATCACTAGAGGA
AAGGGTATGGTTGATACTCTCTTCCAAGCTCCCATGCAATCTGGCACTCACTATGCTGTCATGAGT
TCTTACGACTACATCAGTCAAGGACTTCGCCAGTACAACTTGGACAACAACATGGACGGTTTCTAC
ATAGCACCAGCCTTCATGGACAAGCTTGTCGTCCACATCACCAAGAACTTCTTGAGTCTCCCTAAC
ATCAAGATTCCTCTGATCTTGGGTATCTGGGGAGGCAAAGGTCAAGGAAAATCTTTCCAATGTGAA
CTTGTTTTTGCCAAGATGGGAATCAACCCCATCATGATGAGTGCTGGAGAGCTGGAAAGTGGAAAT
GCAGGAGAACCTGCCAAGCTGATCAGGCAAAGGTACCGTGAAGCTGCTGACATTATCAAGAAGGGT
AAAATGTGCTGCCTGTTCATCAACGATCTCGACGCTGGAGCTGGTCGTATGGGTGGAACAACTCAA
TACACTGTTAACAACCAGATGGTGAATGCCACCCTCATGAACATTGCTGACAACCCAACAAATGTC
CAGCTCCCTGGTATGTACAACAAGGAAGAGAACCCTCGTGTGCCTATCATTGTCACTGGTAACGAC
TTCTCGACATTGTACGCTCCTCTTATCCGTGATGGTCGTATGGAAAAATTCTACTGGGCTCCTACC
AGGGAAGACCGTATTGGTGTCTGCAAGGGTATTTTCAGGACTGACAATGTTCCTGAAGAAGACATT
GTCAAGGTTGTAGACCAATTCCCTGGTCAATCTATTGATTTCTTTGGAGCCCTGAGGGCAAGAGTG
TACGATGATGAAGTGAGGAAGTGGGTTTCCGAAGTCGGTGTCGACACCATCGGNAAGAAGCTGGTG
AACTCAAAGGAAGGACCCCCAACATTTGAGCAGCCCAAGATGACCATTGATAAGCTCCTGCAATAT
GGAAACATGCTTGTGGAAGAGCAAGAAAATGTGAAGAGAGTCCAATTGGCTGACAAGTACATGAGT
GAGGCTGCCCTTGGTGATGCTAACCAGGATGCTATTAAGAGGGGAACTTTCTAA

SEQ ID NO: 279, Larrea tridentata Lartr_RCA SF translated polypeptide sequence
MAAAYSTVGAVNRAPLSLNGSGARASLVPSTAFFGSSLKKSAAKFPKASSGNFKIVAQEISEDQQT
DKDKWKGLAYDISDDQQDITRGKGMVDTLFQAPMQSGTHYAVMSSYDYISQGLRQYNLDNNMDGFY
IAPAFMDKLVVHITKNFLSLPNIKIPLILGIWGGKGQGKSFQCELVFAKMGINPIMMSAGELESGN
AGEPAKLIRQRYREAADIIKKGKMCCLFINDLDAGAGRMGGTTQYTVNNQMVNATLMNIADNPTNV
QLPGMYNKEENPRVPIIVTGNDFSTLYAPLIRDGRMEKFYWAPTREDRIGVCKGIFRTDNVPEEDI
VKVVDQFPGQSIDFFGALRARVYDDEVRKWVSEVGVDTIGKKLVNSKEGPPTFEQPKMTIDKLLQY
GNMLVEEQENVKRVQLADKYMSEAALGDANQDAIKRGTF

SEQ ID NO: 280, Lycopersicon pennellii Lycpe-RCA LF nucleic acid sequence AF037361
ATGGCTGCCTCAGTGTCAACCATTGGAGCTGCCAGCAAAGCACCATTGAGTTTGAACAACTCAGTT
GCTGGAACTTCCGTTCCAAGCACAGCCTTCTTTGGAAAATCCTTGAAAAAGTGTATGCAAAAGGT
GTTTCCAGCCCCAAGGTTTCAAACAGGAACTTGAGGGTTGTAGCTCAAGAAGTAGACGAAACGAAA
GAGGACAGATGGAAGGGTCTTTATGATAACACATCGGATGACCAACAGGACATTGCAAGGGGTAAG
GGTCTGGTCGACAGTCTTTTCCAGGCTCCTACCGGTACTGGTACTCACCACGCCATCATGAATTCC
TACGAATACGTCAGCCAGGCTCTTAAAACGTACCAATTGGACAACAAATTGGACGGCTTCTACATT FIGURE 17 (continued)

GCCCCTGCTTTCATGGACAAACTTGTTGTTCACATCACCAAGAACTTCTTGACATTGCCCAACATC
AAGGTTCCACTCATCTTGGGTGTATGGGGAGGCAAAGGTCAAGGTAAATCATTCCAATGTGAGCTT
GTCTTCAGAAAGATGGGAATCAACCCCATTATGATGAGTGCTGGAGAATTGGAAAGTGGAAATGCA
GGAGAGCCAGCTAAATTGATTAGGCAAAGGTACAGAGAGGCAGCTGAAATCATCAGGAAAGGAAAC
ATGTGTTGTCTCTTCATCAACGATCTCGATGCAGGAGCTGGTAGAATGGGTGGAACTACCCAATAC
ACCGTCAACAACCAGATGGTGAATGCCACCCTCATGAACATTGCTGACAACCCAACAAATGTCCAG
CTCCCCGGTATGTACAACAAGCAAGAGAACGCCAGGGTACCCATTATTGTCACTGGTAACGACTTC
TCCACATTGTATGCTCCTCTTATCCGTGATGGTCGTATGGAGAAGTTCTACTGGGCACCAACTAGG
GAGGATAGAATTGGTGTTTGCAAGGGTATTTTCAGAACTGACAACGTCCCTGAGGAAGCTGTTGTA
AAGATTGTCGATTCCTTCCCTGGACAATCTATTGATTTCTTTGGTGCTTTGAGGGCCCGAGTATAT
GACGATGAAGTGAGGAAATGGGTTTCAGGAACTGGAATTGAACTCATTGGTGAAAAACTTTTGAAC
TCTAGAGATGGACCCCCAACTTTTGAGCAACCAAAAATGACCCTTGAGAAGCTCCTTGAGTATGGT
AACATGCTTGTTCAAGAGCAAGAGAATGTCAAGAGAGTCCAGTTGGCTGAAACCTATCTTAAAGAG
GCAGCTCTCGGAGATGCTAACGCTGATGCCATCAACACTGGAATTTCTAAGAACTTCACCAATCTC
AAAAGTCGTCTAAACAATGAAGAGGCGAAAAAAGCGCGACATGTCAACTTCCAGGAGTGA

SEQ ID NO: 281, Lycopersicon pennellii Lycpe-RCA LF translated
polypeptide sequence
MAASVSTIGAASKAPLSLNNSVAGTSVPSTAFFGKSLKKVYAKGVSSPKVSNRNLRVVAQEVDETK
EDRWKGLYDNTSDDQQDIARGKGLVDSLFQAPTGTGTHHAIMNSYEYVSQALKTYQLDNKLDGFYI
APAFMDKLVVHITKNFLTLPNIKVPLILGVWGGKGQGKSFQCELVFRKMGINPIMMSAGELESGNA
GEPAKLIRQRYREAAEIIRKGNMCCLFINDLDAGAGRMGGTTQYTVNNQMVNATLMNIADNPTNVQ
LPGMYNKQENARVPIIVTGNDFSTLYAPLIRDGRMEKFYWAPTREDRIGVCKGIFRTDNVPEEAVV
KIVDSFPGQSIDFFGALRARVYDDEVRKWVSGTGIELIGEKLLNSRDGPPTFEQPKMTLEKLLEYG
NMLVQEQENVKRVQLAETYLKEAALGDANADAINTGISKNFTNLKSRLNNEEAKKARHVNFQE SEQ ID NO: 282, Malus domestica Maldo_RCA SF nucleic acid sequence
Z21794
ATGGCCACTGCTGTCTCTACCATTGGATCTGTCAACAGAGCACCGCCGAACCTGAATGGCTCTAGC
AGCAGTGCTTCAGTTCCAAGCTCAACCTTTTTGGGAAGCAGCTTGAAGAAAGTGAACTCAAGGTTC
ACGAACTCCAAGGTTTCCTCCGGGAGTCTCAGGATTGTCGCGAGTGTGGACGAAGATAAGCAGACC
GACAAGGACAGATGGAAAGGCCTTGCCTTCGACACCTCCGACGACCAACAAGACATCACAAGAGGA
AAGGGTAAGGTGGACTCCCTCTTCCAGGCACCTCAAGGATCAGGAACTCACTTTGCCATCATGAGC
TCTTATGAATACATCAGCACGGGCCTTCGCCAGTACAACTTTGACAATAACATGGACGGTTATTAT
ATTGCTCCCGCTTTTATGGACAAGCTTGTTGTTCACATCACCAAGAACTTCATGACCCTTCCTAAC
ATGAAGGTTCCTCTCATCTTGGGTATTTGGGGAGGCAAAGGTCAGGGCAAGTCTTTCCAGTGCGAG
CTTGTCTTTGCCAAGATGAGAATCAGCCCTATCATGATGAGTGCCGGAGAATTGGAAAGTGGAAAC
GCAGGAGAACCCGCGAAGCTGATCAGGCAAAGGTACCGTGAAGCAGCCGACATTATCAGGAAGGGT
AAAATGTGTGCACTCTTCATCAACGATCTTGATGCAGGAGCTGGTCGGCTTGGTGGAACCACCCAA
TACACTGTCAACAACCAAATGGTGAATGCCACCCTCATGAACATTGCTGATAACCCGACAAACGTC
CAGCTTCCAGGTATGTACAACAAGGAGGAGAACCCCCGTGTCCCAATCATTGTCACCGGTAACGAT
TTCTCAACATTGTACGCTCCTCTCATCCGTGACGGTCGTATGGAGAAGTTCTACTGGGCTCCCACC
CGCGAAGATCGTATTGGAGTCTGCATTGGGATCTTCAGGAGTGACAATGTTGCTAAGGAAGACATT
GTCAAGCTTGTTGACACCTTCCCAGGCCAATCTATTGATTTCTTTGGTGCCTTGAGGGCTAGGGTT
TACGACGATGAAGTGAGGAAGTGGATTACGGGTGTTGGCGTGGATAGCATTGGGAAGAAGCTTGTG
AACTCAAAGGAAGGACCCCCAACTTTCGAGCAGCCGAAGATGACTATCGAAAAGCTCCTCGAGTAC
GGAAACATGCTTGTCCAAGAGCAAGAGAATGTGAAGAGAGTTCAATTGGCTGATAAGTACTTGAGC
GAGGCTGCTCTTGGTGATGCTAACTCAGATGCTATGAATACAGGAACTTTCTATGGTTAG FIGURE 17 (continued)

SEQ ID NO: 283, Malus domestica Maldo_RCA SF translated polypeptide sequence
MATAVSTIGSVNRAPPNLNGSSSSASVPSSTFLGSSLKKVNSRFTNSKVSSGSLRIVASVDEDKQT
DKDRWKGLAFDTSDDQQDITRGKGKVDSLFQAPQGSGTHFAIMSSYEYISTGLRQYNFDNNMDGYY
IAPAFMDKLVVHITKNFMTLPNMKVPLILGIWGGKGQGKSFQCELVFAKMRISPIMMSAGELESGN
AGEPAKLIRQRYREAADIIRKGKMCALFINDLDAGAGRLGGTTQYTVNNQMVNATLMNIADNPTNV
QLPGMYNKEENPRVPIIVTGNDFSTLYAPLIRDGRMEKFYWAPTREDRIGVCIGIFRSDNVAKEDI
VKLVDTFPGQSIDFFGALRARVYDDEVRKWITGVGVDSIGKKLVNSKEGPPTFEQPKMTIEKLLEY
GNMLVQEQENVKRVQLADKYLSEAALGDANSDAMNTGTFYG

SEQ ID NO: 284, Nicotiana tabacum Nicta_RCA SF nucleic acid sequence U35111
ATGGCTACCTCTGTCTCAACCATTGGAGCTGTTAACAAAACACCGTTGAGTTTGAACAACTCAGTT
GCTGGAACTTCAGTTCCAAGCACAGCCTTCTTTGGCAAAACTTTGAAGAAAGTGTATGGAAAAGGT
GTTTCAAGCCCCAAGGTTACAAACAAGAGCTTGAGGATTGTAGCTGAACAAATAGATGTTGATCCG
AAGAAACAGACCGACAGTGACAGATGGAAGGGTCTTGTCCAAGACTTCTCCGATGATCAACAGGAC
ATCACCCGGGGTAAGGGTATGGTTGACAGTCTTTTCCAGGCTCCAACGGGTACTGGTACTCACCAC
GCTGTGTTGCAATCCTACGAATACGTCAGCCAAGGTCTTCGCCAGTACAACTTGGACAACAAGTTG
GACGGATTCTACATCGCTCCTGCTTTCATGGACAAGCTTGTTGTTCACATCACCAAGAACTTCTTG
AAATTGCCCAACATCAAGGTTCCACTTATCTTGGGTATCTGGGGAGGCAAAGGTCAAGGCAAATCA
TTCCAGTGTGAACTTGTCTTCAGAAAGATGGGAATCAACCCCATTATGATGAGTGCTGGAGAATTG
GAAAGTGGAAATGCAGGAGAGCCAGCCAAGTTGATTAGGCAAAGGTACAGAGAAGCAGCAGAAATC
ATCAGAAAGGGAAATATGTGTTGCCTCTTCATCAACGATCTCGATGCAGGAGCTGGTAGAATGGGT
GGAACTACCCAATACACTGTCAACAACCAAATGGTGAATGCCACTCTCATGAACATTGCTGACAAC
CCGACAAATGTCCAGCTCCCCGGTATGTACAACAAGCAAGAGAATGCCAGGGTCCCTATTATCGTC
ACTGGTAACGATTTCTCCACATTGTATGCTCCACTTATCCGTGATGGTCGTATGGAGAAGTTCTAC
TGGGCACCAACTAGGGAAGACAGAATTGGTGTTTGCACAGGTATTTTCAGGACCGACAATGTTCCT
GCTGAAGACGTTGTCAAGATTGTTGATAACTTCCCTGGACAATCTATCGACTTTTTTGGTGCACTG
AGGGCGAGAGTATACGATGATGAAGTAAGGAAGTGGGTATCAGGCACTGGAATTGAAAAGATTGGA
GACAAACTTTTGAACTCTTTTGACGGACCACCAACTTTTGAGCAACCAAAGATGACCATTGAGAAG
CTCCTCGAGTACGGTAATATGCTTGTACAAGAGCAAGAAAATGTGAAGAGAGTTCAGTTGGCTGAC
AAATACCTCAAAGAGGCTGCACTTGGTGATGCCAATGCTGATGCCATTAACAATGGATCCTTCTTT
GCTAGTTAG

SEQ ID NO: 285, Nicotiana tabacum Nicta_RCA SF translated polypeptide sequence
MATSVSTIGAVNKTPLSLNNSVAGTSVPSTAFFGKTLKKVYGKGVSSPKVTNKSLRIVAEQIDVDP
KKQTDSDRWKGLVQDFSDDQQDITRGKGMVDSLFQAPTGTGTHHAVLQSYEYVSQGLRQYNLDNKL
DGFYIAPAFMDKLVVHITKNFLKLPNIKVPLILGIWGGKGQGKSFQCELVFRKMGINPIMMSAGEL
ESGNAGEPAKLIRQRYREAAEIIRKGNMCCLFINDLDAGAGRMGGTTQYTVNNQMVNATLMNIADN
PTNVQLPGMYNKQENARVPIIVTGNDFSTLYAPLIRDGRMEKFYWAPTREDRIGVCTGIFRTDNVP
AEDVVKIVDNFPGQSIDFFGALRARVYDDEVRKWVSGTGIEKIGDKLLNSFDGPPTFEQPKMTIEK
LLEYGNMLVQEQENVKRVQLADKYLKEAALGDANADAINNGSFFAS

SEQ ID NO: 286, Oryza sativa Orysa_RCA LF nucleic acid sequence AB034698
ATGGCTGCTGCCTTCTCCTCCACCGTTGGAGCTCCGGCGTCCACTCCGACCAACTTCCTGGGGAAG
AAGCTGAAGAAGCAGGTGACATCGGCGGTGAACTACCATGGCAAGAGCTCCAACATCAACAGGTTC

FIGURE 17 (continued)

```
AAGGTGATGGCCAAGGAGCTGGACGAGGGCAAGCAGACCGACCAGGACAGGTGGAAGGGTCTCGCC
TACGACATCTCCGATGACCAGCAGGACATCACCAGGGGGAAGGGTTTCGTCGACTCCCTTTTCCAG
GCTCCCACGGGTGATGGCACCCACGAGGCCGTCCTCAGCTCCTACGAGTACCTCAGCCAGGGTCTC
AGAACGTACGACTTCGACAACACCATGGGAGGCTTCTACATCGCCCCTGCTTTCATGGACAAGCTC
GTCGTCCACATCTCCAAGAACTTCATGACCCTCCCCAACATCAAGGTCCCACTCATCCTGGGTATC
TGGGGAGGCAAGGGTCAGGGAAAATCCTTCCAGTGTGAGCTCGTCTTCGCCAAGATGGGGATCAAC
CCCATCATGATGAGCGCCGGAGAGCTGGAGAGCGGCAACGCCGGAGAGCCGGCGAAGCTGATCAGG
CAGCGGTACCGTGAGGCGGCAGACATCATCAAGAAGGGGAAGATGTGCTGCCTCTTCATCAACGAT
CTGGACGCGGGTGCAGGTCGCATGGGAGGCACCACCCAGTACACGGTGAACAACCAGATGGTGAAC
GCCACCCTGATGAACATCGCCGACAACCCAACCAACGTGCAGCTCCCCGGGATGTACAACAAGGAG
GACAACCCCGTGTCCCCATCATCGTCACCGGCAACGACTTCTCCACGCTGTACGCGCCGCTCATC
CGTGACGGGCGTATGGAGAAGTTCTACTGGGCTCCCACCCGCGACGACCGTGTCGGCGTCTGCAAG
GGTATCTTCCGCACCGACAACGTCCCCGACGAGGACATCGTCAAGATCGTCGACAGCTTCCCAGGC
CAATCCATCGATTTCTTCGGCGCTCTTCGTGCCCGTGTTTACGACGACGAGGTGCGCAAGTGGGTG
TCGGACACGGGTGTGGAGAACATTGGCAAGAGGCTGGTGAACTCGAGGGAGGGCCCACCGGAGTTC
GAGCAGCCCAAGATGACGATCGAAAAGCTCATGGAGTACGGATACATGCTTGTGAAGGAGCAGGAG
AACGTCAAGCGTGTGCAGCTGGCTGAGCAGTACTTGAGCGAGGCTGCTCTTGGTGACGCTAACTCC
GACGCCATGAAGACTGGTTCCTTCTACGGGCAAGGAGCACAGCAAGCAGGTAACCTGCCTGTGCCG
GAAGGTTGCACCGACCCTGTTGCCAAGAACTTCGACCCAACGGCGAGGAGCGACGACGGCAGCTGC
CTTTACACCTTTTAA
```

SEQ ID NO: 287, Oryza sativa Orysa_RCA LF translated polypeptide sequence
```
MAAAFSSTVGAPASTPTNFLGKKLKKQVTSAVNYHGKSSNINRFKVMAKELDEGKQTDQDRWKGLA
YDISDDQQDITRGKGFVDSLFQAPTGDGTHEAVLSSYEYLSQGLRTYDFDNTMGGFYIAPAFMDKL
VVHISKNFMTLPNIKVPLILGIWGGKGQGKSFQCELVFAKMGINPIMMSAGELESGNAGEPAKLIR
QRYREAADIIKKGKMCCLFINDLDAGAGRMGGTTQYTVNNQMVNATLMNIADNPTNVQLPGMYNKE
DNPRVPIIVTGNDFSTLYAPLIRDGRMEKFYWAPTRDDRVGVCKGIFRTDNVPDEDIVKIVDSFPG
QSIDFFGALRARVYDDEVRKWVSDTGVENIGKRLVNSREGPPEFEQPKMTIEKLMEYGYMLVKEQE
NVKRVQLAEQYLSEAALGDANSDAMKTGSFYGQGAQQAGNLPVPEGCTDPVAKNFDPTARSDDGSC
LYTF
```

SEQ ID NO: 288, Oryza sativa Orysa_RCA SF nucleic acid sequence AB034748
```
ATGGCTGCTGCCTTCTCCTCCACCGTTGGAGCTCCGGCGTCCACTCCGACCAACTTCCTGGGGAAG
AAGCTGAAAAAGCAGGTGACATCGGCGGTGAACTACCATGGCAAGAGCTCCAACATCAACAGGTTC
AAGGTGATGGCCAAGGAGCTGGACGAGGGCAAGCAGACCGACCAGGACAGGTGGAAGGGTCTCGCC
TACGACATCTCCGATGACCAGCAGGACATCACCAGGGGGAAGGGTTTCGTCGACTCCCTTTTCCAG
GCTCCCACGGGTGATGGCACCCACGAGGCCGTCCTCAGCTCCTACGAGTACCTCAGCCAGGGTCTC
AGAACGTACGACTTCGACAACACCATGGGAGGCTTCTACATCGCCCCTGCTTTCATGGACAAGCTC
GTCGTCCACATCTCCAAGAACTTCATGACCCTCCCCAACATCAAGGTCCCACTCATCCTGGGTATC
TGGGGAGGCAAGGGTCAGGGAAAATCCTTCCAGTGTGAGCTCGTCTTCGCCAAGATGGGGATCAAC
CCCATCATGATGAGCGCCGGAGAGCTGGAGAGCGGCAACGCCGGAGAGCCGGCGAAGCTGATCAGG
CAGCGGTACCGTGAGGCGGCAGACATCATCAAGAAGGGGAAGATGTGCTGCCTCTTCATCAACGAT
CTGGACGCGGGTGCAGGTCGCATGGGAGGCACCACCCAGTACACGGTGAACAACCAGATGGTGAAC
GCCACCCTGATGAACATCGCCGACAACCCAACCAACGTGCAGCTCCCCGGGATGTACAACAAGGAG
GACAACCCCGTGTCCCCATCATCGTCACCGGCAACGACTTCTCCACGCTGTACGCGCCGCTCATC
```

```
CGTGACGGGCGTATGGAGAAGTTCTACTGGGCTCCCACCCGCGACGACCGTGTCGGCGTCTGCAAG
GGTATCTTCCGCACCGACAACGTCCCCGACGAGGACATCGTCAAGATCGTCGACAGCTTCCCAGGC
CAATCCATCGATTTCTTCGGCGCTCTTCGTGCCCGTGTTTACGACGACGAGGTGCGCAAGTGGGTG
TCGGACACGGGTGTGGAGAACATTGGCAAGAGGCTGGTGAACTCGAGGGAGGGCCCACCGGAGTTC
GAGCAGCCCAAGATGACGATCGAAAAGCTCATGGAGTACGGATACATGCTTGTGAAGGAGCAGGAG
AACGTCAAGCGTGTGCAGCTGGCTGAGCAGTACTTGAGCGAGGCTGCTCTTGGTGACGCTAACTCC
GACGCCATGAAGACTGGTTCCTTCTACGGTTCTGCGCCATCCAGCTGA
```

SEQ ID NO: 289, Oryza sativa Orysa_RCA SF translated polypeptide sequence
```
MAAAFSSTVGAPASTPTNFLGKKLKKQVTSAVNYHGKSSNINRFKVMAKELDEGKQTDQDRWKGLA
YDISDDQQDITRGKGFVDSLFQAPTGDGTHEAVLSSYEYLSQGLRTYDFDNTMGGFYIAPAFMDKL
VVHISKNFMTLPNIKVPLILGIWGGKGQGKSFQCELVFAKMGINPIMMSAGELESGNAGEPAKLIR
QRYREAADIIKKGKMCCLFINDLDAGAGRMGGTTQYTVNNQMVNATLMNIADNPTNVQLPGMYNKE
DNPRVPIIVTGNDFSTLYAPLIRDGRMEKFYWAPTRDDRVGVCKGIFRTDNVPDEDIVKIVDSFPG
QSIDFFGALRARVYDDEVRKWVSDTGVENIGKRLVNSREGPPEFEQPKMTIEKLMEYGYMLVKEQE
NVKRVQLAEQYLSEAALGDANSDAMKTGSFYGSAPSS
```

SEQ ID NO: 290, Phaseolus vulgaris Phavu_RCA SF nucleic acid sequence AF041068
```
ATGGCTGCCTCCCTCTCCACTGTCGGCGCTGTCAACAGAACCCTTTTGAATCTGAATGGATCTGGA
GGCGGAGCTTCAGGTCCCAGTTCAGCTTTCTTTGGCACAAGCTTGAAGAAGGTTATTAGCTCAAGG
GTCCCTAACAGCAAGTTGACATCTGGAAGCTTCAAAATTGTTGCTGCAGACAAAGAGATCGAGGAG
ACCCAGCAGACCGAGGGGGACAGATGGAGGGGTCTAGCCTACGATGTTTCTGATGACCAACAAGAC
ATCACAAGAGGGAAGGGTTTGGTTGATTCTCTTTTCCAAGCTCCAATGGATGCTGGAACTCACTAT
GCAGTCATCAGCTCCCACAAGTACCTCAGCGCTGGACTACGCCAGTACAACTTTGACAACATCAAG
GATGGTTTCTACATTGCTCCAGCTTTTTTGGACAAGCTTGTTGTTCACATCGCCAAGAACTTCATG
ACCTTGCCCAACATCAAGGTTCCTCTCATTCTTGGTGTCTGGGGAGGCAAGGGACAAGGAAAATCT
TTCCAATGTGAGCTTGTCTTTGCCAAGATGGGAATCAACCCCATCATGATGAGTGCTGGAGAGTTG
GAAAGTGGAAATGCCGGAGAGCCAGCAAAATTGATTAGGCAGAGATACCGTGAAGCCTCAGACTTA
ATCAAGAAGGGAAAGATGTGTGTTCTGTTCATCAATGATCTTGATGCAGGAGCAGGTCGTCTTGGT
GGAACCACCCAATACACTGTGAACAACCAGATGGTGAATGCCACTCTCATGAACATTGCTGATAAC
CCCACAAATGTGCAGCTTCCTGGTATGTACAACAAGGAAGATAACGCCCGTGTGCCCATCATTGTC
ACTGGTAACGATTTCTCAACACTTTATGCTCCTCTCATCCGTGATGGTCGTATGGAGAAGTTCTAC
TGGGCACCAACAAGGGAAGACCGCATTGGTGTTTGCAAGGGAATTTTCCGGACCGATGGTGTTCCT
GAAAAGGACATTGTCGAGCTTGTTGACAAACACCCTGGCCAATCCATTGATTTCTTTGGTGCACTG
AGGGCCAGAGTGTATGATGATGAAGTAAGGAAGTGGATTTCTGGTGTTGGTGTTGATTCTGTTGGG
AAGAAGCTTGTGAACTCAAAGGAAGGACCTCCTACCTTTGACCAGCCCAAGATGACTCTGGACAAG
CTCTTGCTGTATGCTAGCATGCTTGTCCAAGAACAAGAGAATGTGAAGAGAGTCCAATTGGCTGAC
CAGTACTTGAATGAGGCTGCTCTTGGAAATGCCAACGAGGATGCTATCAAGAGTGGATCTTTCTTC
AAATAG
```

SEQ ID NO: 291, Phaseolus vulgaris Phavu_RCA SF translated polypeptide sequence
```
MAASLSTVGAVNRTLLNLNGSGGGASGPSSAFFGTSLKKVISSRVPNSKLTSGSFKIVAADKEIEE
TQQTEGDRWRGLAYDVSDDQQDITRGKGLVDSLFQAPMDAGTHYAVISSHKYLSAGLRQYNFDNIK
DGFYIAPAFLDKLVVHIAKNFMTLPNIKVPLILGVWGGKGQGKSFQCELVFAKMGINPIMMSAGEL
```

FIGURE 17 (continued)

ESGNAGEPAKLIRQRYREASDLIKKGKMCVLFINDLDAGAGRLGGTTQYTVNNQMVNATLMNIADN
PTNVQLPGMYNKEDNARVPIIVTGNDFSTLYAPLIRDGRMEKFYWAPTREDRIGVCKGIFRTDGVP
EKDIVELVDKHPGQSIDFFGALRARVYDDEVRKWISGVGVDSVGKKLVNSKEGPPTFDQPKMTLDK
LLLYASMLVQEQENVKRVQLADQYLNEAALGNANEDAIKSGSFFK

SEQ ID NO: 292, Triticum aestivum Triae_RCA SF nucleic acid sequence AF251264
ATGGCTTCTGCTTTCTCGTCCACCGTTGGAGCTCCGGCGTCGACCCCGACCACCTTCCTCGGGAAG
AAGGTGAAGAAGCAGGCCGGTGCGTTGAACTACTACCATGGTGGCAACAAGATCAACAATAGGGTG
GTCAGGGCCATGGCGGCCAAAAAGGAACTTGACGAGGGCAAGCAGACCGATGCCGATCGGTGGAAG
GGTCTCGCTTACGACATCTCCGATGACCAGCAGGACATCACGAGGGGGAAAGGCATCGTGGACTCC
CTGTTCCAGGCCCCCATGGGCGACGGCACCCACGAGGCCATCCTGAGCTCCTACGAGTACATCAGC
CAGGGCCTGCGCAAGTACGACTTCGACAACACCATGGACGGGCTGTACATCGCCCCGGCGTTCATG
GACAAGCTCATCGTCCACCTCGCCAAGAACTTCATGACACTCCCCAACATCAAGGTCCCTCTCATC
CTGGGTATCTGGGGAGGCAAGGGACAGGGCAAGTCGTTCCAGTGCGAGCTGGTGTTCGCCAAGATG
GGCATCAACCCCATCATGATGAGCGCCGGAGAGCTGGAGAGCGGCAACGCCGGCGAGCCGGCCAAG
CTGATCCGGCAGAGGTACCGCGAGGCTGCCGACATTATCAAGAAGGGCAAGATGTGCTGCCTCTTC
ATCAACGACCTGGACGCCGGCGCGGGGCGGATGGGCGGGACGACGCAGTACACGGTGAACAACCAG
ATGGTGAACGCCACCCTGATGAACATCGCGGACGCGCCCACCAACGTGCAGTTCCCGGGGATGTAC
AACAAGGAGGAGAACCCACGCGTGCCCATCATCGTCACCGGCAACGACTTCTCGACGCTGTACGCG
CCCCTCATCCGGGACGGCCGCATGGAGAAGTTCTACTGGGCGCCCACCCGGGAGGACCGCATCGGC
GTGTGCAAGGGCATCTTCCGCACCGACAACGTCCCCGACGAGGCCGTGGTGAGGCTGGTGGACACC
TTCCCGGGGCAGTCCATCGACTTCTTCGGCGCGCTGCGGGCGCGGGTGTACGACGACGAGGTGCGC
AAGTGGGTCGGCGAGATCGGCGTCGAGAACATCTCCAAGCGGCTCGTCAACTCCAGGGAGGGGCCG
CCGACGTTCGACCAGCCCAAGATGACCATCGAGAAGCTCATGGAGTACGGCCACATGCTGGTCCAG
GAGCAGGAGAACGTGAAGCGCGTGCAGCTCGCCGACAAGTACCTCAGCGAGGCGGCGCTCGGCCAA
GCCAACGACGACGCCATGGCGACCGGCGCCTTCTACGGCAAGTAG

SEQ ID NO: 293, Triticum aestivum Triae_RCA SF translated polypeptide sequence
MASAFSSTVGAPASTPTTFLGKKVKKQAGALNYYHGGNKINNRVVRAMAAKKELDEGKQTDADRWK
GLAYDISDDQQDITRGKGIVDSLFQAPMGDGTHEAILSSYEYISQGLRKYDFDNTMDGLYIAPAFM
DKLIVHLAKNFMTLPNIKVPLILGIWGGKGQGKSFQCELVFAKMGINPIMMSAGELESGNAGEPAK
LIRQRYREAADIIKKGKMCCLFINDLDAGAGRMGGTTQYTVNNQMVNATLMNIADAPTNVQFPGMY
NKEENPRVPIIVTGNDFSTLYAPLIRDGRMEKFYWAPTREDRIGVCKGIFRTDNVPDEAVVRLVDT
FPGQSIDFFGALRARVYDDEVRKWVGEIGVENISKRLVNSREGPPTFDQPKMTIEKLMEYGHMLVQ
EQENVKRVQLADKYLSEAALGQANDDAMATGAFYGK

SEQ ID NO: 294, Zea mays Zeama_RCA SF nucleic acid sequence contig of EE034185.1, BI675068
ATGGCCGCCTTCTCCTCCACCGTCGGAGCTCCGGCCTCCACCCCGACCAGGAGCAGCTTCCTCGGG
AAGAAGCTCAACAAGCCGCAGGTGTCCGCGGCCGTGACCTACCATGGCAAGAGCTCCAGCAGCAAC
AGCAGGTTCAAGGCGATGGCTGCCAAGGAGGTGGACGAGACGAAGCAGACCGACGAGGACAGGTGG
AAGGGCCTGGCCTACGACATCTCGGACGACCAGCAGGACATCACCAGGGGCAAGGGCCTCGTCGAC
AACCTCTTCCAGGCGCCTATGGGGACGGCACCCACGTCGCCGTGCTCAGCTCCTACGACTACATC
AGCCAGGGCCAAAAGTCTTACAACTTCGACAACATGATGGATGGCTTCTACATAGCCAAGGGCTTC
ATGGACAAGCTCGTCGTCCACCTCTCCAAGAACTTCATGACCCTGCCAAACATCAAGGTTCCCCTC FIGURE 17 (continued)

```
ATCCTGGGTATCTGGGGAGGCAAAGGCCAGGGAAAATCGTTCCAATGCGAGCTGGTCTTCGCCAAG
ATGGGCATCACCCCCATCATGATGAGCGCCGGCGAGCTGGAGAGCGGCAACGCCGGAGAGCCCGCC
AAGCTCATCAGGCAGCGCTACCGTGAGGCCTCCGACCTCATCAAGAAGGGCAAGATGTCCTGCCTC
TTCATCAACGACCTCGACGCCGGCGCGGGTCGCATGGGCGGCACCACCCAGTACACGGTGAACAAC
CAGATGGTCAACGCCACCCTGATGAACATCGCCGACAACCCCACCAACGTGCAGCTCCCGGGGATG
TACAACAAGGAGGACAACCCCCGCGTGCCCATCATCGTCACCGGCAACGACTTCTCCACGCTCTAC
GCGCCGCTCATCCGCGACGGCCGCATGGAGAAGTTCTACTGGGCGCCCACCCGCGAGGACCGCATC
GGCGTCTGCAAGGGCATCTTCCGCACCGACGGCGTCGACGAGGAGCACGTCGTCCAGCTGGTCGAC
ACCTTCCCTGGCCAGTCCATCGACTTCTTCGGCGCGCTGCGTGCCCGGGTCTACGACGACGAGGTC
CGACGGTGGGTGAGCGAGACCGGCGTCGAGAACATCGCCAGGAAGCTCGTCAACTCCAAGGAGGGC
CCGCCCACGTTCGAGCAGCCCAAGATAACGATCGAGAAGCTCTTGGAGTACGGACACATGCTGGTG
GCGGAGCAGGAGAACGTCAAGCGTGTGCAGCTTGCTGACAAGTACCTCAACGAGGCTGCTCTTGGT
GAAGCCAACGAGGACGCCATGAAGACTGGCTCCTTCTTCAAGTAG
```

SEQ ID NO: 295, Zea mays Zeama_RCA SF translated polypeptide sequence
MAAFSSTVGAPASTPTRSSFLGKKLNKPQVSAAVTYHGKSSSSNSRFKAMAAKEVDETKQTDEDRW
KGLAYDISDDQQDITRGKGLVDNLFQAPMGDGTHVAVLSSYDYISQGQKSYNFDNMMDGFYIAKGF
MDKLVVHLSKNFMTLPNIKVPLILGIWGGKGQGKSFQCELVFAKMGITPIMMSAGELESGNAGEPA
KLIRQRYREASDLIKKGKMSCLFINDLDAGAGRMGGTTQYTVNNQMVNATLMNIADNPTNVQLPGM
YNKEDNPRVPIIVTGNDFSTLYAPLIRDGRMEKFYWAPTREDRIGVCKGIFRTDGVDEEHVVQLVD
TFPGQSIDFFGALRARVYDDEVRRWVSETGVENIARKLVNSKEGPPTFEQPKITIEKLLEYGHMLV
AEQENVKRVQLADKYLNEAALGEANEDAMKTGSFFK SEQ ID NO: 296, Datisca glomerata Datgl_RCA partial nucleic acid sequence AF047352
```
ATGGCTTCTTCCGCTGTCTCAACCATTGGAGCAGTCAACAGATCCCCTTTAAATTTGAACAACAAT
GGAACTGGAGGGTTGCTGCCAAACACAGCCTTCTTTGGCAGCAGTCTGAAGAAGATGAACTCAAGA
TTGACCAATCCGAGGATTGCTGCTGGCAACATTAAGGCTGTTGCTGACGATGACGAGGAAAAACAA
ACATCGAAGGACAGGTGGGGAGGCCTTGCCTTTGACACATCTGATGACCAACAAGACATTACCAGA
GGAAAGGGAATGGTTGATTCCCTTTTCCAAGCTCCCATGCAAACTGGAACTCACTATGCTGTCATG
AGCTCTTATGAATACCTCAGCACTGGTCTTCGCCAATACTTGGATAACAATATGGATGGATTCTAC
ATAGCTCCAGCTTTCATGGACAAGCTTGTCGTTCACATCACCAAAAACTTCATGACTCTCCCCAAC
ATAAAGGTTCCTCTCATTTTGGGTATCTGGGGAGGTAAAGGTCAAGGTAAATCTTTCCAGTGTGAG
CTTGTCTTTGCCAAGATGGGAATCAACCCCATCATGATGAGTGCCGGAGAATTGGAGAGCGGCAAC
GCAGGAGAGCCCGCGAAGTTGATCAGGCAACGGTGTCGTGAGGCGGCCGACATCATCAAGAAGGGA
AAGATGTCTTGCCTATTTATCAATGATCTTGATGCAGGTGCCGGTAGGCTTGGTGGGACAACTCAA
TACACTGTGAACAACCAAATGGTGAATGCTACCCTCATGAACATTGCTGACAATCCAACCAATGTT
CAGCTCCCGGGTATGTACAACAAGGAAGAGAATCCACGTGTACCGATCATCGTCACAGGTAATGAC
TTCTCGACATTGTACGCTCCTCTCATTCGTGATGGTCGTATGGAGAAATTCTACTGGGCGCCCACC
AGAGAAGACCGAATTGGTGTCTGCACTGGTATCTTCAGAAGTGACAATGTGGCTAAGGAAGATATT
GTCAAGCTTGTTGACACATTCCCTGGTCAATCTATTGATTTCTTCGGGGCGCTAAGAGCACGGGTT
TACGACGACGAAGTGAGGAAGTGGATATCGGGTGTCGGAGTACAGGACGTTGGAAAAAGCTTGTGA
```

SEQ ID NO: 297, Datisca glomerata Datgl_RCA partial translated polypeptide sequence
MASSAVSTIGAVNRSPLNLNNNGTGGLLPNTAFFGSSLKKMNSRLTNPRIAAGNIKAVADDDEEKQ
TSKDRWGGLAFDTSDDQQDITRGKGMVDSLFQAPMQTGTHYAVMSSYEYLSTGLRQYLDNNMDGFY FIGURE 17 (continued)

IAPAFMDKLVVHITKNFMTLPNIKVPLILGIWGGKGQGKSFQCELVFAKMGINPIMMSAGELESGN
AGEPAKLIRQRCREAADIIKKGKMSCLFINDLDAGAGRLGGTTQYTVNNQMVNATLMNIADNPTNV
QLPGMYNKEENPRVPIIVTGNDFSTLYAPLIRDGRMEKFYWAPTREDRIGVCTGIFRSDNVAKEDI
VKLVDTFPGQSIDFFGALRARVYDDEVRKWISGVGVQDVGKSL

SEQ ID NO: 298, Zantedeschia aethiopica Zanae_RCA partial nucleic acid sequence AF338240
GCCGTCTCCAGCGTCGGTGCCGTGAACAGGGTCCGGCCTAGCCTACATGGGTCTGGTTCGGGAGCC
TCGGTGACGAGGTCCGGCTTCCTGGGCACCAGCCTGAAGACGGTGAACCCCAGCTTGGGTCATGGC
AGGACCTCCACTGGGACCTTGAAGGTCATGGCTGCTGACCTCGACGAGAGCAAGCAGACCAAGACA
GACAGGTGGGCTGGGCTGTACACCGACACCTCGGATGACCAGCAGGACATCACCAGGGGGAAGGGC
ATGGTCGACTCCCTGTTCCAGGCTCCCATGGGCGACGGAACCCACAACCCCGTCCTGAGCTCCTAC
GAGTACATCAGCACCGGTCTCCGCTCGTTCAACTTGGACAACACCGTGAATGGTTTATACATCGCT
CCGGCCTTCATGGACAAGCTTGTCGTTCACATCACCAAGAACTTCATGAACTTGCCCAACATCAAG
ATTCCTCTCATTTTGGGTATCTGGGGAGGCAAAGGTCAAGGGAAATCCTTCCAATGTGAACTTGTG
TTCGCCAAGATGGGAATCAACCCCATCATGATGAGCGCCGGTGAGCTGGAGAGCGGCAACGCCGGA
GAGCCGGCGAAGCTGATCCGGCAGCGGTACCGTGAGGCCGCCGACATCATCAGGAAGGGGAAGATG
TGCTGCCTCTTCATCAACGATCTCGATGCCGGTGCCGGCCGGATGGGCGGCACCACCCAGTACACC
GTCAACAACCAGATGGTGAACGCCACCCTCATGAACATCGCCGACAACCCCACCAACGTCCAGCTC
CCCGGCATGTACAACAAGCAAGAGAACCCCGCGTGCCCATCATCGTCACCGGCAACGACTTCTCC
ACCCTCTACGCCCCCCTCATCCGTGACGGTCGTATGGAGAAGTTCTACTGGGCTCCCACCAGGGAT
GACCGGGTCGGCGTCTGCACCGGTATCTTCAGGTCCGACAACGTCCCCAAGGAGGATGTCATCAAG
CTCGTCGACACCTTCCCCGGCCAATCCATTGACTTCTTCGGTGCACTGAGGGCGAGGGTCTACGAC
GACGAGGTGAGGAAGTGGATTGCCGAAATCGGCGTCGACGGCGTGGGGAAGAGGCTGGTGAACTCG
CTGGAGGGGCCGCCGACGTTCGCGCAGCCCAAGATGACCCTGGACAAGCTGCTGGAGTACGGCAAT
ATGCTGGTGCAGGAACAGGAGAACGTGAAGAGGGTGCAGCTGGCCGACAAGTACCTGAGCGAGGCA
GCTCTTGGTGACGCCAATCAGGACGCGATCAAGACTGGATCCTTCTATGGTTAG SEQ ID NO: 299, Zantedeschia aethiopica Zanae_RCA partial translated polypeptide sequence
AVSSVGAVNRVRPSLHGSGSGASVTRSGFLGTSLKTVNPSLGHGRTSTGTLKVMAADLDESKQTKT
DRWAGLYTDTSDDQQDITRGKGMVDSLFQAPMGDGTHNPVLSSYEYISTGLRSFNLDNTVNGLYIA
PAFMDKLVVHITKNFMNLPNIKIPLILGIWGGKGQGKSFQCELVFAKMGINPIMMSAGELESGNAG
EPAKLIRQRYREAADIIRKGKMCCLFINDLDAGAGRMGGTTQYTVNNQMVNATLMNIADNPTNVQL
PGMYNKQENPRVPIIVTGNDFSTLYAPLIRDGRMEKFYWAPTRDDRVGVCTGIFRSDNVPKEDVIK
LVDTFPGQSIDFFGALRARVYDDEVRKWIAEIGVDGVGKRLVNSLEGPPTFAQPKMTLDKLLEYGN
MLVQEQENVKRVQLADKYLSEAALGDANQDAIKTGSFYG SEQ ID NO: 300, Anabaena variabilis ATCC 29413 Anasp_RCA nucleic acid sequence CP000117.1
ATGAGTTATTATATCGCTCCGCGCTTTCTGGATAAACTTGCTGTTCACATCACCAAAAACTTTTTA
AATATTCCTGGTGTGCGAGTTCCCTTAATTTTAGGGATTCATGGACGTAAAGGAGAAGGGAAAACC
TTTCAGTGTGAGTTAGCTTTTGAGAAGATGGGTATTGAAGTCACACTCATCTCCGGCGGTGAATTG
GAAAGTCCCGATGCGGGAGACCCAGCCCGGTTGATTCGGCTGCGCTATCGGGAACGGCAGAACTG
ATTAAAGTGCGGGGTAAAATGTGCGTGCTGATGATTAACGATTTAGATGCAGGTGCAGGACGCTTT
GATGAAGGTACGCAATATACTGTAAATACTCAGTTGGTAAATGCCACACTGATGAATATTGCCGAT
AATCCCACAGATGTACAGTTACCCGGTAGTTATGATTCCAACCCGATACGGCGTGTCCCCATTATC

```
GTGACAGGTAATGATTTTTCTACTCTCTACGCACCATTGATTCGGGATGGACGGATGGAGAAATTC
TATTGGGAACCCAACCGCGATGATAAGGTGGGAATTGTCGGGGGGATTTTTGCTGAGGATGGACTC
TCAAAACGAGAAATTGAACAATTAGTTGATACTTTCCCCAAGCAATCGATTGACTTTTTTAGCGCT
TTACGTTCTCGAATTTACGACGAACAAATCCGCGACTTTATCCATCAAGTTGGGTTTGAACGTATA
TCTCTACGTGTTGTGAACAGCGTAGAAGCGCCGCCAGAATTTAAAAAGCCAGATTTCAGCCTTGCT
CATTTGATCGAGTCTGGTAACTTGGTGTTGGGTGAACAACAACGGGTAGACAATTCTCAGCTAGTG
GATGAGTATAATCGATTGAATCGCGGGAGGGGTTATCAAGCAGCGCCACCGCCTGAAGCGCCCATG
ATTCAGCCAGTCAATAATAGTTCTCACAAGCGAGAGACATCTAATACTCATTTGAGTTTAGAAACC
CAAGAACAAATCCGGCAAATCTTGTCTCAAGGTCACAAAATTACTTTTGAACACGTAGATGCACGC
CGCTTCCGCACGGGTTCTTGGCAAAGTTGCGGTACTCTGCATATTGATGCAGAGTCAGATGCTATT
TCAACACTAGAGGCTTGCTTAGTTGATTATGAGGGTGAGTATGTGCGCTTGGTAGGGATAGACCCG
AAAGGTAAGCGGCGGGTTGTGGAGACAATTATTCAACGACCAAATGACAAAAACTAA
```

SEQ ID NO: 301, Anabaena variabilis ATCC 29413 Anava_RCA translated polypeptide sequence
```
MSYYIAPRFLDKLAVHITKNFLNIPGVRVPLILGIHGRKGEGKTFQCELAFEKMGIEVTLISGGEL
ESPDAGDPARLIRLRYRETAELIKVRGKMCVLMINDLDAGAGRFDEGTQYTVNTQLVNATLMNIAD
NPTDVQLPGSYDSNPIRRVPIIVTGNDFSTLYAPLIRDGRMEKFYWEPNRDDKVGIVGGIFAEDGL
SKREIEQLVDTFPKQSIDFFSALRSRIYDEQIRDFIHQVGFERISLRVVNSVEAPPEFKKPDFSLA
HLIESGNLVLGEQQRVDNSQLVDEYNRLNRGRGYQAAPPPEAPMIQPVNNSSHKRETSNTHLSLET
QEQIRQILSQGHKITFEHVDARRFRTGSWQSCGTLHIDAESDAISTLEACLVDYEGEYVRLVGIDP
KGKRRVVETIIQRPNDKN
```

SEQ ID NO: 302, Nostoc sp. PCC 7120 Nossp_RCA nucleic acid sequence BA000019.2
```
ATGAGTTATTATATCGCTCCGCGTTTTCTGGATAAACTTGCTGTTCACATCACTAAAAACTTTTTG
AATATTCCTGGTGTGCGAGTTCCCTTAATTTTAGGGATTCATGGACGTAAAGGAGAAGGGAAAACC
TTTCAATGTGAGTTAGCTTTTGAAAAGATGGGTATTGAAGTCACACTCATCTCTGGCGGTGAATTG
GAAAGTCCCGATGCGGGAGACCCAGCACGGTTGATTCGGCTGCGTTATCGGGAAACGGCAGAACTG
ATCAAAGTGCGCGGTAAAATGTGCGTGCTGATGATTAACGATTTAGATGCAGGTGCAGGACGCTTT
GATGAAGGTACGCAATATACTGTAAATACTCAGTTGGTAAATGCCACGCTGATGAATATTGCTGAT
AATCCTACAGATGTGCAGTTACCGGGTAGTTATGATTCCAACCCGATACGGCGTGTCCCCATTATC
GTCACAGGTAATGATTTTTCTACTCTCTACGCGCCATTGATTCGGGATGGACGGATGGAGAAATTC
TATTGGGAACCCAACCGTGATGATAAGGTGGGAATTGTTGGGGGGATTTTTGCGGAAGATGGACTG
TCACAACGGGAAATTGAGCAATTAGTTGATACTTTCCCCAAGCAATCGATTGACTTTTTTAGCGCT
TTACGTTCTCGAATTTACGATATCCAAATCCGCGACTTCATCCATAAAGTCGGGTTTGAACGGATA
TCTTTGCGCGTAGTGAACAGCCTAGAAGCGCCGCCAGAATTTAAAAAGCCAGATTTCAGCCTGGCT
CATTTAATCGAGTCTGGTAACTTGGTGTTGGGTGAACAACAACGGGTAGATAATTCTCAGTTAGTG
GATGAGTATAATCGATTAAATCGCGGGAGAGGTTATCAAACAGCGCCACCCCCGAAGCACCAGTG
ATTCAGCCAGTCAATAATAGTTCTCACAAGCAAAGACATCTAATACTCATTTGAGTTTAGAAACC
CAAGAACAAATCCGGCAAATCTTGTCTCAAGGTCACAAAATTACCTTTGAACACGTAGATGCACGC
CGTTTCCGCACGGGTTCTTGGCAGAGTTGCGGTACTCTGCATATTGATGCAGAGTCAGATGCTATT
TCAACTTTAGAGGCTTGCTTAGTTGATTATGACGGTGAGTATGTGCGGATGGTAGGGATAGACCCG
AAAGGCAAGCGGCGGGTTGTAGAGACAATTATTCAACGACCAAATGGCAAAATTAA
```

FIGURE 17 (continued)

SEQ ID NO: 303, Nostoc sp. PCC 7120 Nossp_RCA translated polypeptide sequence
MSYYIAPRFLDKLAVHITKNFLNIPGVRVPLILGIHGRKGEGKTFQCELAFEKMGIEVTLISGGEL
ESPDAGDPARLIRLRYRETAELIKVRGKMCVLMINDLDAGAGRFDEGTQYTVNTQLVNATLMNIAD
NPTDVQLPGSYDSNPIRRVPIIVTGNDFSTLYAPLIRDGRMEKFYWEPNRDDKVGIVGGIFAEDGL
SQREIEQLVDTFPKQSIDFFSALRSRIYDIQIRDFIHKVGFERISLRVVNSLEAPPEFKKPDFSLA
HLIESGNLVLGEQQRVDNSQLVDEYNRLNRGRGYQTAPPPEAPVIQPVNNSSHKQKTSNTHLSLET
QEQIRQILSQGHKITFEHVDARRFRTGSWQSCGTLHIDAESDAISTLEACLVDYDGEYVRMVGIDP
KGKRRVVETIIQRPNGKN

SEQ ID NO: 304, Synechococcus sp. JA-3-3Ab Synco_RCA nucleic acid sequence CP000239
ATGAGCTACTACATCCCCCCCACCTTTCTTAAAGTTGTCGCCCTGCACCTGACCAAAAATCATCTT
CCTCTGCCCGACGTGCCCGTTCCGCTCATCTTGGGCATCCACGGGCGCAAGGGGGAGGGCAAGACC
TTCCAATGCAACCTCATCTTTGAGCGCATGAAGGTCTATGCCGTCCACATCTCGGGGGGCGAGCTG
GAAAGTCCCGACGCCGGGGATCCCGCCCGTATGATTCGCCTGCGCTACCGTGAAGCTGCCGAGCAC
ATCCGCAAATTTGGCCAGATGGCCGTGCTGATGATCAACGACCTGGATGCCGGCGCCGGTCGCCTG
AACAGCATGACCCAGTACACCGTCAACACCCAACTGGTGAGCGCCACCCTGATGAACATCGCCGAC
AACCCCACCAACGTGCAGCTTCCCGGCAGCTACGATCCCAAGCCCTGCCGCGGGTGCCCATCATC
GCCACCGGCAACGACTTTTCCACCCTCTATGCCCCCTCATCCGCGATGGGCGCATGCGCAAGTTC
TACTGGGAGCCCAGCCGCACCGACCGCATCCACATCGTTCACGGCATTTTTCAAGCCGACGGCTG
TCTCTTGAGGAGATTGAGCGCCTGGTGGACGCCTTTCCCGAGCAGGCCATCGACTTTTTCGGCGCC
CTGCGCGCCCAGCTCTACGACGAGCAGGTATGGCAATTTATCCAAGAAGTCGGCCTGGAAGGGATT
GCCTTTCGCCTGCTCAAAAGCAAAGAGGGCGCCCCCAGTTTCCGCCACCGCGATTTTCTCTGGAG
CAGTTGATCCAGGCCGGCCACCAGCTCAAAGCCGAGCAACACCAAGTAGAAGCCCGTCGCCTCTCC
GAGGAATACCTTGGCCTCCGGCGCTCCGCTCCTCAAGAGCCGCCCCCGCTTCCCCGCCATCCCCT
CCTCCTGTGGCTGCCAACTCGGCCGATCCTGCCCCAGTCTCCCTCAACCCAGACGTGCAGGCCCAG
CTTCGCCAGATCCTGGCCCAAGGCTATGAGATCCTGGTGGAGCATGCGGATCCGCGCCGCTACCGC
GTTCATTCCTGGCAGGAGTGTGGAGTTGCCCACCTGAGAGAATGGGCCGCTGCCTGTCAGGCTGTC
GAGCAGTGCCTCAGCCGTTTTCCCAAGGACTACATCCGGCTGGTGGGCGTAGATCCGGTGAAAAAA
CAACGGCGGGTCGAGGCCATCATCCACCGCCCCTGA

SEQ ID NO: 305, Synechococcus sp. JA-3-3Ab Synco_RCA nucleic acid sequence CP000239
MSYYIPPTFLKVVALHLTKNHLPLPDVPVPLILGIHGRKGEGKTFQCNLIFERMKVYAVHISGGEL
ESPDAGDPARMIRLRYREAAEHIRKFGQMAVLMINDLDAGAGRLNSMTQYTVNTQLVSATLMNIAD
NPTNVQLPGSYDPKPLPRVPIIATGNDFSTLYAPLIRDGRMRKFYWEPSRTDRIHIVHGIFQADGL
SLEEIERLVDAFPEQAIDFFGALRAQLYDEQVWQFIQEVGLEGIAFRLLKSKEGAPQFPPPRFSLE
QLIQAGHQLKAEQHQVEARRLSEEYLGLRRSAPQEPPPASPPSPPPVAANSADPAPVSLNPDVQAQ
LRQILAQGYEILVEHADPRRYRVHSWQECGVAHLREWAAACQAVEQCLSRFPKDYIRLVGVDPVKK
QRRVEAIIHRP

SEQ ID NO: 306, Oryza sativa GOS2 promoter
AATCCGAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG

FIGURE 17 (continued)

```
AGGTAGCCATAATTGTCATCAAACTCTTCTTGAATAAAAAAATCTTTCTAGCTGAACTCAATGGGT
AAAGAGAGAGATTTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTCCTCCCATCTATAA
ATTCCTCCCCCTTTTCCCCTCTCTATATAGGAGGCATCCAAGCCAAGAAGAGGGAGAGCACCAAG
GACACGCGACTAGCAGAAGCCGAGCGACCGCCTTCTTCGATCCATATCTTCCGGTCGAGTTCTTGG
TCGATCTCTTCCCTCCTCCACCTCCTCCTCACAGGGTATGTGCCCTTCGGTTGTTCTTGGATTTAT
TGTTCTAGGTTGTGTAGTACGGGCGTTGATGTTAGGAAAGGGGATCTGTATCTGTGATGATTCCTG
TTCTTGGATTTGGGATAGAGGGGTTCTTGATGTTGCATGTTATCGGTTCGGTTTGATTAGTAGTAT
GGTTTTCAATCGTCTGGAGAGCTCTATGGAAATGAAATGGTTTAGGGTACGGAATCTTGCGATTTT
GTGAGTACCTTTTGTTTGAGGTAAAATCAGAGCACCGGTGATTTTGCTTGGTGTAATAAAAGTACG
GTTGTTTGGTCCTCGATTCTGGTAGTGATGCTTCTCGATTTGACGAAGCTATCCTTTGTTTATTCC
CTATTGAACAAAAATAATCCAACTTTGAAGACGGTCCCGTTGATGAGATTGAATGATTGATTCTTA
AGCCTGTCCAAAATTTCGCAGCTGGCTTGTTTAGATACAGTAGTCCCCATCACGAAATTCATGGAA
ACAGTTATAATCCTCAGGAACAGGGGATTCCCTGTTCTTCCGATTTGCTTTAGTCCCAGAATTTTT
TTTCCCAAATATCTTAAAAAGTCACTTTCTGGTTCAGTTCAATGAATTGATTGCTACAAATAATGC
TTTTATAGCGTTATCCTAGCTGTAGTTCAGTTAATAGGTAATACCCCTATAGTTTAGTCAGGAGAA
GAACTTATCCGATTTCTGATCTCCATTTTTAATTATATGAAATGAACTGTAGCATAAGCAGTATTC
ATTTGGATTATTTTTTTATTAGCTCTCACCCCTTCATTATTCTGAGCTGAAAGTCTGGCATGAAC
TGTCCTCAATTTTGTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAATCGG
GATAGTTATACTGCTTGTTCTTATGATTCATTTCCTTTGTGCAGTTCTTGGTGTAGCTTGCCACTT
TCACCAGCAAAGTTC

SEQ ID NO: 307, Oryza sativa HMGB promoter
CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGGCGGGTTACCCTGGGGGTGTGGGTGGATGACGGGTGGGCCCGGAGGAGGTCCGGCCC
CGCGCGTCATCGCGGGGCGGGGTGTAGCGGGTGCGAAAAGGAGGCGATCGGTACGAAAATTCAAAT
TAGGAGGTGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCTCCTCTCCTCTTCTCTTCT
```

FIGURE 17 (continued)

CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGCCCTTCTCGCAGG
ATTCAGCC

SEQ ID NO: 308, Oryza sativa protochlorophyllide reductase promoter
TTGCAGTTGTGACCAAGTAAGCTGAGCATGCCCTTAACTTCACCTAGAAAAAGTATACTTGGCTT
AACTGCTAGTAAGACATTTCAGAACTGAGACTGGTGTACGCATTTCATGCAAGCCATTACCACTTT
ACCTGACATTTTGGACAGAGATTAGAAATAGTTTCGTACTACCTGCAAGTTGCAACTTGAAAAGTG
AAATTTGTTCCTTGCTAATATATTGGCGTGTAATTCTTTTATGCGTTAGCGTAAAAAGTTGAAATT
TGGGTCAAGTTACTGGTCAGATTAACCAGTAACTGGTTAAAGTTGAAAGATGGTCTTTTAGTAATG
GAGGGAGTACTACACTATCCTCAGCTGATTTAAATCTTATTCCGTCGGTGGTGATTTCGTCAATCT
CCCAACTTAGTTTTTCAATATATTCATAGGATAGAGTGTGCATATGTGTGTTTATAGGGATGAGTC
TACGCGCCTTATGAACACCTACTTTTGTACTGTATTTGTCAATGAAAAGAAATCTTACCAATGCT
GCGATGCTGACACCAAGAAGAGGCGATGAAAAGTGCAACGGATATCGTGCCACGTCGGTTGCCAAG
TCAGCACAGACCCAATGGGCCTTTCCTACGTGTCTCGGCCACAGCCAGTCGTTTACCGCACGTTCA
CATGGGCACGAACTCGCGTCATCTTCCCACGCAAAACGACAGATCTGCCCTATCTGGTCCCACCCA
TCAGTGGCCCACACCTCCCATGCTGCATTATTTGCGACTCCCATCCCGTCCTCCACGCCCAAACAC
CGCACACGGGTCGCGATAGCCACGACCCAATCACACAACGCCACGTCACCATATGTTACGGGCAGC
CATGCGCAGAAGATCCCGCGACGTCGCTGTCCCCGTGTCGGTTACGAAAAAATATCCCACCACGT
GTCGCTTTCACAGGACAATATCTCGAAGGAAAAAATCGTAGCGGAAAATCCGAGGCACGAGCTGC
GATTGGCTGGGAGGCGTCCAGCGTGGTGGGGGCCCACCCCCTTATCCTTAGCCCGTGGCGCTCCT
CGCTCCTCGGGTCCGTGTATAAATACCCTCCGGAACTCACTCTTGCTGGTCACCAACACGAAGCAA
AAGGACACCAGAAACATAGTACACTTGAGCTCACTCCAAACTCAAACACTCACACCA

SEQ ID NO: 309, prm08444
GGGGACAAGTTTGTACAAAAAAGCAGGCTTAAACAATGCAGGTCACCATGAAGAG

SEQ ID NO: 310, prm08445
GGGGACCACTTTGTACAAGAAAGCTGGGTCTCCTACAGAGGAGGCACATC

SEQ ID NO: 311, Chlre_RCA AAA domain
ILGIWGGKGQGKTFQCALAYKKLGIAPIVMSAGELESGNAGEPAKLIRTRYREASDIIKKGRMCSL
FINDLDAGAGRMGDTTQYTVNNQMVNATLMNIADNPTNVQLPGVYKNEEIPRVPIVCTGNDFSTLY
APLIRDGRMEKYYWNPTREDRIGVCMGIFQEDNVQRREVENLVDTFPGQSIDFFGALRARVYDDMV
R

SEQ ID NO: 312, Motif 1
G(G/R)KG(Q/E)GK(S/T)

SEQ ID NO: 313, Flaveria bidentis Flabi_RCA nucleic acid sequence EU202926.1
ATGGCCACCGCCGCCATCGGAGCCACCTTCAACCGCACCCCGTTGAGCAGTGGTGTTGCTGCGGTC
CCGAGTTCGAGCTTCTTAGGCACTAGCTTGAAGAAGATTGTGAACTCGAGACATGCAGTCAACAAC
AACAAGTTTTCCACTTTCAAGATCTTTGCAGCCGAGAAAGAGATCGAAGAGACCAAACAAACCGAC
AAAGATAGATGGAGAGGACTCGCGTATGATATGTCGGATGATCAACAAGACATCACTAGAGGTAAG FIGURE 17 (continued)

```
GGTATGGTTGATTCTCTCTTCCAGGCTCCACAAGATTCTGGAACCCATTTCGCTGTCATGAGTTCC
TACGAATACATCAGCACTGGTCTTCGCACATATTTGGACAACAACATGGATGGATTCTATATCGCG
CCTGCGTTTATGGACAAGCTCGTTGTTCACATCACCAAGAACTTCATGACTTTGCCCAACATTAAG
GTCCCTCTAATTTTGGGTGTTTGGGGAGGCAAAGGTCAGGGTAAATCTTTCCAATGTGAACTTGTG
TTTGCCAAGATGGGAATCACACCGATTATGATGAGTGCTGGAGAATTGGAAAGTGGAAACGCCGGA
GAGCCCGCGAAGCTCATCAGACAGCGGTACCGTGAGGCGGCCGATATCATCAAGAAGGGGAAAATG
TGTTGCCTCTTCATCAATGATCTTGATGCAGGAGCAGGTAGAATGGGTGGAACAACACAATACACA
GTCAACAACCAGATGGTCAACGCTACCCTCATGAACATTGCTGATAACCCCACCAATGTGCAACTG
CCTGGAATGTACAACAAGGAGGAGAACCCGCGTGTCCCGATCATCGTCACAGGAAACGACTTTCG
ACACTCTATGCTCCCCTCATTCGTGACGGTCGTATGGAAAAGTTCTATTGGGCTCCCACTAGAGAT
GACCGAATTGGCGTGTGTATTGGTATTTTCCGCACTGACAATGTCCCGAAAGAAGACATTGTCAAA
CTCGTCGATACTTTCCCTGGACAATCCATTGATTTCTTTGGCGCGTTGAGGGCTAGAGTGTACGAC
GATGAAGTGAGGAAGTGGATCGGAGAAGTTGGTGTTGAAACCATTGGAAAGAAGCTTGTGAACTCA
AGGGAAGGACCCCCGACATTCGAGCAACCCAAAATGACAATCGATAAGCTCCTTGAGTACGGATAC
ATGCTTGTTCAGGAACAAGAGAATGTGAAGAGAGTCCAGTTGGCCGATACCTATTTGGATTCTGCG
GCGCTTGGTGACGCTAACAAGGATGCCATGGAGACTGGCAAATTCTTTGCCGGAAAAGAATAG

SEQ ID NO: 314, Flaveria bidentis Flabi_RCA translated polypeptide
sequence
MATAAIGATFNRTPLSSGVAAVPSSSFLGTSLKKIVNSRHAVNNNKFSTFKIFAAEKEIEETKQTD
KDRWRGLAYDMSDDQQDITRGKGMVDSLFQAPQDSGTHFAVMSSYEYISTGLRTYLDNNMDGFYIA
PAFMDKLVVHITKNFMTLPNIKVPLILGVWGGKGQGKSFQCELVFAKMGITPIMMSAGELESGNAG
EPAKLIRQRYREAADIIKKGKMCCLFINDLDAGAGRMGGTTQYTVNNQMVNATLMNIADNPTNVQL
PGMYNKEENPRVPIIVTGNDFSTLYAPLIRDGRMEKFYWAPTRDDRIGVCIGIFRTDNVPKEDIVK
LVDTFPGQSIDFFGALRARVYDDEVRKWIGEVGVETIGKKLVNSREGPPTFEQPKMTIDKLLEYGY
MLVQEQENVKRVQLADTYLDSAALGDANKDAMETGKFFAGKE SEQ ID NO: 315, Ostreococcus lucimarinus Ostlu_RCA nucleic acid
sequence jgi_Ost9901_3_31184_eugene.0400010260
ATGTCCACGATCACGCAGCCGCGATGCGGCGTCAAGGCGAACGCCACGGCGAAGCGCGCCGTCGCG
CCGAAGACCTTCCTCGGCGCGCGCGTCTCCTCCGTGTCGAACGGTTCCAAGGTTGAGATGAGCCGA
TGGAAGGGCATGGACATGGACATTTCCGACGACCAGCAAGACATCGCTCGCGGCCGCAACATGGTT
GACTCCAAGTTCCAAGGCGCGACCGGAATCGGTGGTACGCACAACGCCGTCATGTCCTCGCAAGAT
TACTTGTCCGCGGGCATGAAGACGTACTCTGCGCACGACAACATCACCACGGAGAACTTCTACATC
TCCCCGTCGTACATGGACAAGGTGATCGTGCACGTCGCGAAGAACTTCATGAAGTTGCCGAAGATC
AAGGTGCCGGTCATTCTCGGTGTCTGGGGTGGTAAGGGTCAAGGTAAGACTTTCCAGTCTGATTTG
ATCTTCAAGAAGCTCGGCATCTCCCCGATCGTCATGTCCGCCGGTGAGCTCGAATCCGGCAACGCC
GGTGAACCGGCCAAGCTCGTGCGTCAGCGTTACCGCGAAGCGTCCGACATCGTCAAGAAGGGTCGC
ATGTCTACCCTCTTCATCAACGATCTTGACGCTGGTGCCGGTCGTATGGGTGGCACGACGCAATAC
ACCGTCAACAACCAAATGGTGAACGCGACGCTCATGAACATCGCGGATAACCCCACGAACGTTCAG
TTGCCGGGCCAATACGAAGTCATCGAAATCCCGCGTGTGCCGATCATCGCCACCGGTAACGATTTC
TCCACCCTTTACGCGCCGCTCGTCCGTGATGGCCGTATGGACAAGTTCTACTGGTCCCCGACCCGC
GAAGACCGCGTCGGCATCGCCAACGGTATCTTCATGGCGGATGGCATCGAGAAGGAAGACGTCGAA
GTCCTCGTCGATACGTTCGAAGGTCAATCCATTGACTTCTTCGGCGCGCTTCGCTCCCGTGTCTAC
GATGACTTGGTGCGTGACTTCATCCTCGAAGTCGGCTACGAAGCTCTCGGCCCGCGCCTCATCAAC
CCGCGCAAGGGTGAAGAAGTCAACTTCAACCCGCCGAAAATGACGCTCGAAGTCCTCTTGGCGTAC
GGTAAGGAATTGGAGAACGAGCAAGAGAACATCAAGCGCATCCAGTTGGCCGATGCCTACTTGGAC
GGCGCCGTGCTCGCGGGCGAAGGCGGTTCCTCGAACACCGAGAAGTCGCTCAACCAGTAA
```

SEQ ID NO: 316, Ostreococcus lucimarinus Ostlu_RCA translated
polypeptide sequence
MSTITQPRCGVKANATAKRAVAPKTFLGARVSSVSNGSKVEMSRWKGMDMDISDDQQDIARGRNMV
DSKFQGATGIGGTHNAVMSSQDYLSAGMKTYSAHDNITTENFYISPSYMDKVIVHVAKNFMKLPKI
KVPVILGVWGGKGQGKTFQSDLIFKKLGISPIVMSAGELESGNAGEPAKLVRQRYREASDIVKKGR
MSTLFINDLDAGAGRMGGTTQYTVNNQMVNATLMNIADNPTNVQLPGQYEVIEIPRVPIIATGNDF
STLYAPLVRDGRMDKFYWSPTREDRVGIANGIFMADGIEKEDVEVLVDTFEGQSIDFFGALRSRVY
DDLVRDFILEVGYEALGPRLINPRKGEEVNFNPPKMTLEVLLAYGKELENEQENIKRIQLADAYLD
GAVLAGEGGSSNTEKSLNQ SEQ ID NO: 317, Vigna radiata Vigra_RCA nucleic acid sequence
AF126870
atggctgcctccgtctccactgtcggagctgtcaacagagctatttttgaacctgaatggatcagga
gcaggagcttcagctcccacttcagctttctttggcacaagcttgaagaaggctgttgcctcaagg
gtccctaacagcaaggtgacgaatggaagcttcaaaattgttgctgctgagaaagagattgaggag
agccagcagaccaacaaggacagatggaagggtctggcctacgatatctctgatgaccaacaagac
atcacaaggggggaagggtatggttgatcctctttttccaagctccaatggatgctggaacacactat
gccgtcatgagctcctacgaataccttagcactggactccgacagcttgacaacataaaggatggt
ttctacattgctcctgcttttctggacaagcttgttgttcacatcaccaagaacttcatgaccttg
cccaacatcaaggttcctctcattcttggtatctggggaggcaagggacaaggaaagtcttttccaa
tgtgagcttgtctttgccaagatgggaatcaaccccatcatgatgagtgctggagagttggaaagt
ggaaatgccggagagccagcaaaattgatcaggcagagataccgtgaagctgcagatttgatcgcc
aagggaaagatgtgtgctctattcatcaacgatcttgatgcaggagcaggtcgtcttggtggaacc
acccaatacactgtgaacaaccagatggtgaatgccactctcatgaacattgctgataaccctaca
aatgtgcagcttcctggtatgtacaacaaggaagagaacgcccgtgtgcccatcattgtcaccggt
aatgatttctcaacgctgtatgctcctctcattcgtgatgggcgtatggagaagttctactgggca
ccaacaagggacgaccgcgttggtgtttgcaagggaattttccgcaccgatggtgttcctgaagag
gacattacaaagcttgttgacaccttcccaggccaatctattgatttctttggtgcactgagggcc
agagtgtatgatgatgaagtgaggaagtggatttctggtgttggtgttgatgctactgggaagaag
cttgtgaactcaaaggaaggacctcctacctttgatcagcccaagatgagtctggacaagctcttg
cagtatggtaacatgcttgtccaagaacaagaaaatgtgaagagagtccaattggctgacaagtac
ttgaatgaggctgctcttggaaatgctaacgaagatgctattaagagtggatctttcttcaaatag SEQ ID NO: 318, Vigna radiata Vigra_RCA translated polypeptide
sequence
MAASVSTVGAVNRAILNLNGSGAGASAPTSAFFGTSLKKAVASRVPNSKVTNGSFKIVAAEKEIEE
SQQTNKDRWKGLAYDISDDQQDITRGKGMVDPLFQAPMDAGTHYAVMSSYEYLSTGLRQLDNIKDG
FYIAPAFLDKLVVHITKNFMTLPNIKVPLILGIWGGKGQGKSFQCELVFAKMGINPIMMSAGELES
GNAGEPAKLIRQRYREAADLIAKGKMCALFINDLDAGAGRLGGTTQYTVNNQMVNATLMNIADNPT
NVQLPGMYNKEENARVPIIVTGNDFSTLYAPLIRDGRMEKFYWAPTRDDRVGVCKGIFRTDGVPEE
DITKLVDTFPGQSIDFFGALRARVYDDEVRKWISGVGVDATGKKLVNSKEGPPTFDQPKMSLDKLL
QYGNMLVQEQENVKRVQLADKYLNEAALGNANEDAIKSGSFFK

FIGURE 17 (continued)

SEQ ID NO: 319, Volvox carteri Volva_RCA nucleic acid sequence jgi_Volca1_105291_estExt_fgenesh4_pg.C_260106
ATGCAGACCACCATGAAGGGCAGCGCCATCTCTGGCCAGCGCGTGGGCAGCGCCCGCGTCGCCGCA
CGTAGCGTGCGCAGGGCTCAGCTTCAGGTTGTAGCTGCTAGCCGCTCTCAGGTTGGTCGCTGGCGC
AATATCGACGCCGATGTTGACACCTCGGACGACCAGCAAGACATCACCCGCGGTCGCCAGATGGTC
GACGACCTCTTCCAGGGTGGCTTCGGCGCCGGTGGCACGCACAACGCCGTGCTGTCGTCCACCGAG
TACCTGAGCCAGGCCCGCGCCTCGTTCAACAACATTGAGGATGGTTTCTACATCTCACCGGCTTTC
CTTGACAAGATGACCATCCACATTGCTAAGAACTTCATGGATCTGCCGAAGATTAAAGTCCCACTC
ATTCTCGGCATCTGGGGTGGCAAGGGTCAGGGCAAGACTTTCCAGTGCGCTCTGGCGTACAAGAAG
CTCGGCATCTCACCCATTGTCATGTCGGCTGGTGAGCTCGAGTCCGGCAATGCTGGTGAGCCTGCC
AAGCTGATCCGCACCCGCTACCGGGAGGCGTCCGACATCATCAAGAAGGGCAAGATGTGCTCCCTG
TTCATCAACGATCTGGATGCTGGTGCTGGCCGTATGGGTGACACCACCCAGTACACCGTCAACAAC
CAGATGGTCAACGCAACGCTGATGAACATTGCCGATAACCCGACCAACGTGCAGCTGCCGGGTGTC
TACAAGAACGAGGAGATCCCCCGCGTGCCAATCGTCTGCACGGGTAACGACTTCTCGACCCTGTAC
GCTCCCCTCATTCGTGATGGCCGTATGGAGAAGTACTACTGGAACCCCACCCGCGAGGACCGCATT
GGTGTGTGCATGGGCATCTTCCAGGAGGACAACGTCAGCCGTGGCGACGTTGAGCGCCTGGTCGAC
ACCTTCCCTGGCCAATCCATTGATTTCTTCGGCGCCCTCCGCGCTCGCGTCTACGATGACATGGTG
CGCAAGTGGATTGCCGAGGTCGGCATTGAGGGCATCGGCAGCAAGCTGGTCAACGGCAGGCAGAAG
GTGTCGTTCCCTAAGGTGTCGATGTCGCTGGACGTGCTGCTGAAGTACGGCCGCGCCCTGGTTGAC
GAGCAGGAGAACGTCAAGCGCGTGCAGCTGGCCGATGCCTACCTGTCTGGTGCCGAGCTGGCTGGC
CGTGAGGGCTCGTCGCTGCCGGAGGAGTACTCTCGCCGGTAA

SEQ ID NO: 320, Volvox carteri Volva_RCA translated polypeptide sequence
MQTTMKGSAISGQRVGSARVAARSVRRAQLQVVAASRSQVGRWRNIDADVDTSDDQQDITRGRQMV
DDLFQGGFGAGGTHNAVLSSTEYLSQARASFNNIEDGFYISPAFLDKMTIHIAKNFMDLPKIKVPL
ILGIWGGKGQGKTFQCALAYKKLGISPIVMSAGELESGNAGEPAKLIRTRYREASDIIKKGKMCSL
FINDLDAGAGRMGDTTQYTVNNQMVNATLMNIADNPTNVQLPGVYKNEEIPRVPIVCTGNDFSTLY
APLIRDGRMEKYYWNPTREDRIGVCMGIFQEDNVSRGDVERLVDTFPGQSIDFFGALRARVYDDMV
RKWIAEVGIEGIGSKLVNGRQKVSFPKVSMSLDVLLKYGRALVDEQENVKRVQLADAYLSGAELAG
REGSSLPEEYSRR FIGURE 17 (continued)

*MPNTSSSQSF*TIFVDGWLIRHRYFVEQLMCASSLDETNRISLEEQQSLVAQFLSHC
LQYYQEKFASVSLAGDNVFTFFCPPWFNSYAKLILWVGDFKPSLVFKLTE*VSVADL*
*TRHQKDRISSLKSETRRKEREV*MRDFA*LVQQSVADPPVM*LAARRVGAVGMVDGEET
DLEEAMEVLKAGMAAAMNNADQLRCSTVGKVVEILTPPQAIKVLRTIGQL*HLRLRD*
*RDQERA*

FIGURE 18

```
CLUSTAL W (1.83) multiple sequence alignment arabidopsisABF19046.1"             ------------------------------------------
ZW2"AT1G58330"NP_564730.1"         ------------------------------------------
SEQ ID NO: 02                      ------------------------------------------
AT4G18690"                         ------------------------------------------
At4g18690"                         ------------------------------------------
AT4G18680"NP_193603.1"             ------------------------------------------
Nicotiana                          ------------------------------------------
Os01g0159000"NP_001042081.1"       ------------------------------------------
AT4G18650                          ------------------------------------------
OBF4""CAA49524.1"                  MNTTSTHFVPPRRFEVYEPLNQTGMWEESFKNNGD--MYTPGSTIIPTNE 48
At5g10030"bZip                     MNITSTHFVPPRRFEVYEPLNQIGMWEESFKNNGD--MYTPGSIIIPTNE 48
EBP-1b"="CAA40102.1"               MAEAS-----PR-------------TETSTDDTDENLMLEPGNAALAVVS 32 arabidopsisABF19046.1"             ---------------------------------------MPITSSSETF 10
ZW2"AT1G58330"NP_564730.1"         ---------------------------------------MPITSSSETF 10
SEQ ID NO: 02                      ---------------------------------------MPNTSSSQSF 10
AT4G18690"                         -----------------------------------MATSSSSYGIEQLQ 14
At4g18690"                         -----------------------------------MATSSSSYGIEQLQ 14
AT4G18680"NP_193603.1"             ------------------------------------------
Nicotiana                          ---------------------------------MASSLMKRNG---VEKNDKTF 18
Os01g0159000"NP_001042081.1"       -------------------------MPPPSPHPPHRNGNHVPAPSGESF 24
AT4G18650                          ---------------------------------MSKMRN-----LVEEKF 12
OBF4""CAA49524.1"                  KPDSLSEDTSHGTEGTPHKFDQEASTSRHPDKIQRRLAQNREAARKSRLR 98
At5g10030"bZip                     KPDSLSEDTSHGTEGTPHKFDQEASTSRHPDKIQRRLAQNREAARKSRLR 98
EBP-1b"="CAA40102.1"               D----SSDRSRDKNGD-------------QKTMRRLAQNREAARKSRLR 64 arabidopsisABF19046.1"             ASFFNDWLCRHRQFVQQLAHLA-------------------------- 32
ZW2"AT1G58330"NP_564730.1"         ASFFNDWLCRHRQFVQQLAHLA-------------------------- 32
SEQ ID NO: 02                      TIFVDGWLIRHRYFVEQLMCASSL------------------------ 34
AT4G18690"                         KGCYYEWMSVQAKHIVDLKEALMS------------------------ 38
At4g18690"                         KGCYYEWMSVQAKHIVDLKEALMS------------------------ 38
AT4G18680"NP_193603.1"             -------MSLQTKHIDDLKEALMC------------------------ 17
Nicotiana                          HEFFRTWIAEQKQELKELVSASRDVSK--------------------- 45
Os01g0159000"NP_001042081.1"       AKFFRCWTSEQSRDLAALRSAASAATN--------------------- 51
AT4G18650                          LEFYESWVIQLELYLHQLLIAH-------------------------- 34
OBF4""CAA49524.1"                  KKAYVQQLETSRLKLIHLEQELDRARQQGFYVGNGVDTNALSFSDNMS-S 147
At5g10030"bZip                     KKAYVQQLETSRLKLIHLEQELDRARQQGFYVGNGVDTNALSFSDNMS-S 147
EBP-1b"="CAA40102.1"               KKAYVQQLENSRLKLTQLEQELQRARQQGIFISSSADQ-----SIISMSGN 109
                                                 :       :     *
```

FIGURE 19

```
                                                                                        MOTIF 1
arabidopsisABF19046.1"       ------------------------DETTIVTPIEEESLVSNFLSHYLQY  57
ZW2"AT1G58330"NP_564730.1"   ------------------------DETTIVTPIEEESLVSNFLSHYLQY  57
SEQ ID NO: 02                ------------------------DETNRTSLEEQQSLVAQFLSHCLQY  59
AT4G18690"                   ------------------------HRSKEDHKLEELVGKIVNDFQKY  61
At4g18690"                   ------------------------HRSKEDHKLEELVGKIVNDFQKY  61
AT4G18680"NP_193603.1"       ------------------------QRNN-DDKLEDLVGKIVNDYHTY  39
Nicotiana                    ------------------------GNNNVVEERVLVPLIKRVIQHYECY  70
Os01g0159000"NP_001042081.1" ------------------------PAAPPDDAELHRLVNRVLGHYEHY  75
AT4G18650                    ------------------------NNNTMSETELRHLISKLTTHHKAY  58
OBF4""CAA49524.1"            CIVAFEMEYGHWVEEQNRQICELRTVLHGQVSDIELRSLVENAMKHYFQL 197
At5g10030"bZip               CIVAFEMEYGHWVEEQNRQICELRTVLHGQVSDIELRSLVENAMKHYFQL 197
HBP-1b"="CAA40102.1"         CALAFDTEYARWLEEHNRQVNELRAAVNAHAGDTELRSVVEKIMSHYDEI 159
                                                                       ::  .   .

MOTIF 1                  MOTIF 2
arabidopsisABF19046.1"       YEEKSVAMSVAGDDIYDFFGPPWLSSYEKLILWIGGFKPGMVFKLITTSV 107
ZW2"AT1G58330"NP_564730.1"   YEEKSVAMSVAGDDIYDFFGPPWLSSYEKLILWIGGFKPGMVFKLITTSV 107
SEQ ID NO: 02                YQEKFASVSLAGDNVFTFCPPWFNSYAKLILWVGDFKPSLVFKLTEVSV  109
AT4G18690"                   TEKR---SELSRRSCSSYFAPSWNSPLENGLLWMGGCRPSSFIRVIYSLC 108
At4g18690"                   TEKR---SELSRRSCSSYFAPSWNSPLENGLLWMGGCRPSSFIRVIYSLC 108
AT4G18680"NP_193603.1"       AGKR---SELSYRCCAHYFAPSWNTPIENSMLWMGGCRPSSFIRLIYALC  86
Nicotiana                    YEEK---SKYTEEDVFGMLNPTWRSNLEGAFLWIGGWRPSMAFELLYSKS 117
Os01g0159000"NP_001042081.1" YRTK---SAAASTDVLRMFSPSWTSTTENLYLWCGGWRPTAALIILYSKS 122
AT4G18650                    YTAK---WAAIREDVLAFFGSVWLNPLENACSWLTGWKPSMVFRMVDRLR 105
OBF4""CAA49524.1"            FRMK---SAAAKIDVFYVMSGMWKTSAERFFLWIGGFRPSELLKVLLPHF 244
At5g10030"bZip               FRMK---SAAAKIDVFYVMSGMWKTSAERFFLWIGGFRPSELLKVLLPHF 244
HBP-1b"="CAA40102.1"         FKQK---GNAAKADVFHVLSGMWKTPAERCFLWLGGFRPSELLKLLSTQL 206
                              :                  *  .       *       :*    :::

arabidopsisABF19046.1"       X--------------------------DLTSHQIDQLESIRLETKRRER 130
ZW2"AT1G58330"NP_564730.1"   X--------------------------DLTSHQIDQLESIRLETKRRER 130
SEQ ID NO: 02                A--------------------------DLTRHQKDRISSLKSETRRKER 132
AT4G18690"                   CSQAETQLSQYLLKIDENVEVNHGCSMSDLNASQLAKINDLHIKVIEKED 158
At4g18690"                   GSQAETQLSQYLLKIDENVEVNHGCSMSDLNASQLAKTNDLHIKVIEKED 158
AT4G18680"NP_193603.1"       GSQAETQLSQYLLKIDDDFDINHGGFMSDLTATQLGKLNDLHLEVIKKED 136
Nicotiana                    GLQFEARLPQLTRG-------TTTGDLGYLSPDQTDKVDELQKKTTREEK 160
Os01g0159000"NP_001042081.1" GAQLETQLPVFLAGG-----GLGAGDLGDLSARQLQAADQLQRTTVSKER 167
AT4G18650                    ------------------------KSRVVLVEAQVKKLEELRVKTKEDEQ 131
OBF4""CAA49524.1"            DP--------------------------LTDQQLLDVCNLRQSCQQSED 267
At5g10030"bZip               DP--------------------------LTDQQLLDVCNLRQSCQQAED 267
HBP-1b"="CAA40102.1"         EP--------------------------LTEQQLSCICNLQQSSQQAED 229
                                                          *   *      .::     * arabidopsisABF19046.1"       DLMRRFALLQQSVGDPLLMVPFRRTG-----------VLRLGEGEQPEME 169
ZW2"AT1G58330"NP_564730.1"   DLMRRFALLQQSVGDPLLMVPFRRTG-----------VLRLGEGEQPEME 169
SEQ ID NO: 02                EVMRDFALVQQSVADPPVMLAARRVG-----------AVGMVDGEETDLE 171
AT4G18690"                   KITKKSANLQENVADMPIAIAAYAT---------------DLMNGDVVVE 193
At4g18690"                   KITKKSANLQENVADMPIATAAYAT---------------DLMNGDVVVE 193
AT4G18680"NP_193603.1"       KITKTSANFQDDVADLPIA--------------------DVVEADVAVE  165
Nicotiana                    KSSEKLARVQETVADASMVELSHIVTQLMMTSGSRGGGGGGGKTLDEEVE 210
Os01g0159000"NP_001042081.1" EIENAAASAQESLATVKMVEL---------------AGGGGMDAEGME  200
AT4G18650                    KIEREMERYQVAMADRKMVELARLG-------------CHVGGESVMVVE 168
OBF4""CAA49524.1"            ALSQGMEKLQHTLAESVAA--GKLGEGS----------------YIPQMT 299
At5g10030"bZip               ALSQGMEKLQHTLAESVAA--GKLGEGS----------------YIPQMT 299
HBP-1b"="CAA40102.1"         ALSQGMEALQQSLAETLAGSIGSSGSGST---------GNVANYMGQMA  269
                               .   *  ::.                                   :
```

FIGURE 19 (continued)

```
                                                                    MOTIF 3
arabidopsisABF19046.1"           DAMEVLKVEMIKAMKNADQLRCVTVGKVVEVLNPRQSIKLLRAAGEFYLR 219
ZW2"AT1G58330"NP_564730.1"       DAMEVLKVEMIKAMKNADQLRCVTVGKVVEVLNPRQSIKLLRAAGEFYLR 219
SEQ ID NO: 02                    EAMEVLKACMAAAMNNADQLRCSTVGKVVEILTPPQAIKVLRTIGQLHLR 221
AT4G18690"                       DALDKYEEGMAVLMVEADKLRFETLRKIVDVVTPVQAAEFLLAGKRLHIS 243
At4g18690"                       DALDKYEEGMAVLMVEADKLRFETLRKIVDVVTPVQAAEFLLAGKRLHIS 243
AT4G18680"XP_193603.1"           DALDKHEEGMAVLLAEADKLRFETLRKIVDVVTPLQAVEFLLAGKRLQLS 215
Nicotiana                        ANLATKEEGLIIILQKADNLRLNTLKEILAILTPTQAIHFLIAAAELHLR 260
Os01g0159000"NP_001042081.1"     MEMRSKADGMRRVLEMADGLRLTTMREVVATLRPSQAVHFLIAAAELHLA 250
AT4G18650                        AAVRGLSMCLEKMVKAADCVRLKTLKGILDILTPPQCVEFLAAAATFQVQ 218
OBF4""CAA49524.1"                CAMERLEA-LVSFVNQADHLRHETLQQMHRILTTRQAARGLLALGEYFQR 348
At5g10030"oZip                   CAMERLEA-LVSFVNQADHLRHETLQQMHRILTTRQAARGLLALGEYFQR 348
HBP-1b"="CAA40102.1"             MAMGKLGT-LENFLSQADNLRQQTLQQMQRILTTRQSARALLVISDYSSR 318
                                         :        :     ** :* *:  :   ::    *. .  * arabidopsisABF19046.1"           LRDLGV-------------------------------------------- 225
ZW2"AT1G58330"NP_564730.1"       LRDLGV-------------------------------------------- 225
SEQ ID NO: 02                    LRDRDQERA----------------------------------------- 230
AT4G18690"                       LHEWGRVREEQRFGCVRTDAAAATGGAGTEKSKRSSLLMLKLHSFYIKII 293
At4g18690"                       LHEWGRVREEQRFGCVRTDAAAATGGAGTEKSKRSSLLM----------- 282
AT4G18680"XP_193603.1"           LIIDRGVR---------ADVCGGVGGAAV--------------------- 235
Nicotiana                        LHEWGKIEDATASRTPARRYYHHEHQLSGCNSERVEDEYPTHETICALPR 310
Os01g0159000"NP_001042081.1"     VHEFGRRKDGDGAASPP--------------------------------- 267
AT4G18650                        LRRWGNRRHYVTHS------------------------------------ 232
OBF4""CAA49524.1"                LRALSSSWAARQREPT---------------------------------- 364
At5g10030"oZip                   LRALSSSWAARQREPT---------------------------------- 364
HBP-1b"="CAA40102.1"             LRALSSLWLARPKE------------------------------------ 332
                                 ::   .

arabidopsisABF19046.1"           -------------------------------------------------
ZW2"AT1G58330"NP_564730.1"       -------------------------------------------------
SEQ ID NO: 02                    -------------------------------------------------
AT4G18690"                       KTCMVNFGNYFERLPVKLPNNRHVEKEKKKEVKEEEVENWGLRELIDGGD 343
At4g18690"                       -------------------------------------------------
AT4G18680"XP_193603.1"           -------------------------------------------------
Nicotiana                        TEINNPMRTPAAPCARACPPHAKKPRPIYAGPGWEGQRMPASYLQPRRGT 360
Os01g0159000"NP_001042081.1"     ----------PA------------------------------------- 269
AT4G18650                        -------------------------------------------------
OBF4""CAA49524.1"                -------------------------------------------------
At5g10030"oZip                   -------------------------------------------------
HBP-1b"="CAA40102.1"             ------------------------------------------------- arabidopsisABF19046.1"           -------------------------------------------------
ZW2"AT1G58330"NP_564730.1"       -------------------------------------------------
SEQ ID NO: 02                    -------------------------------------------------
AT4G18690"                       AAPGRILIRNNINIGSSRFVSYNSF------------------------ 368
At4g18690"                       -------------------------------------------------
AT4G18680"XP_193603.1"           -------------------------------------------------
Nicotiana                        NGRRIMEHGAGEEMVAFYEAWVGREERIVADLTDALLPARRRRDVLAPLV 410
Os01g0159000"NP_001042081.1"     -------------------------------------------------
AT4G18650                        -------------------------------------------------
OBF4""CAA49524.1"                -------------------------------------------------
At5g10030"oZip                   -------------------------------------------------
HBP-1b"="CAA40102.1"             -------------------------------------------------
```

FIGURE 19 (continued)

```
arabidopsisABF19046.1"                   ------------------------------------------------
ZW2"AT1G58330"NP_564730.1"               ------------------------------------------------
SEQ ID NO: 02                            ------------------------------------------------
AT4G18690"                               ------------------------------------------------
At4g18690"                               ------------------------------------------------
AT4G18680"NP_193603.1"                   ------------------------------------------------
Nicotiana                                DAAVGHVSEYYERKARLADRDVVAALDPRWLNPLERTFLWAWGWKPALVF  460
Os01g0159000"NP_001042081.1"             ------------------------------------------------
AT4G18650                                ------------------------------------------------
OBF4""CAA49524.1"                        ------------------------------------------------
At5g10030"bZip                           ------------------------------------------------
HBP-1b"="CAA40102.1"                     ------------------------------------------------ arabidopsisABF19046.1"                   ------------------------------------------------
ZW2"AT1G58330"NP_564730.1"               ------------------------------------------------
SEQ ID NO: 02                            ------------------------------------------------
AT4G18690"                               ------------------------------------------------
At4g18690"                               ------------------------------------------------
AT4G18680"NP_193603.1"                   ------------------------------------------------
Nicotiana                                RFADGAVAGGSSHQQQRRALERVRAATAEAEREVDREVAVVQESLAGPRV  510
Os01g0159000"NP_001042081.1"             ------------------------------------------------
AT4G18650                                ------------------------------------------------
OBF4""CAA49524.1"                        ------------------------------------------------
At5g10030"bZip                           ------------------------------------------------
HBP-1b"="CAA40102.1"                     ------------------------------------------------ arabidopsisABF19046.1"                   ------------------------------------------------
ZW2"AT1G58330"NP_564730.1"               ------------------------------------------------
SEQ ID NO: 02                            ------------------------------------------------
AT4G18690"                               ------------------------------------------------
At4g18690"                               ------------------------------------------------
AT4G18680"NP_193603.1"                   ------------------------------------------------
Nicotiana                                LAALRRQHPRNGEADEAVAAVGRSLRVLLAAADALRERTVRDVVGTLAPD  560
Os01g0159000"NP_001042081.1"             ------------------------------------------------
AT4G18650                                ------------------------------------------------
OBF4""CAA49524.1"                        ------------------------------------------------
At5g10030"bZip                           ------------------------------------------------
HBP-1b"="CAA40102.1"                     ------------------------------------------------ arabidopsisABF19046.1"                   ---------------------------------
ZW2"AT1G58330"NP_564730.1"               ---------------------------------
SEQ ID NO: 02                            ---------------------------------
AT4G18690"                               ---------------------------------
At4g18690"                               ---------------------------------
AT4G18680"NP_193603.1"                   ---------------------------------
Nicotiana                                QAGAFLAAMLRFHLGVERAGRNWGSGNGGRRGL  593
Os01g0159000"NP_001042081.1"             ---------------------------------
AT4G18650                                ---------------------------------
OBF4""CAA49524.1"                        ---------------------------------
At5g10030"bZip                           ---------------------------------
HBP-1b"="CAA40102.1"                     ---------------------------------
```

FIGURE 19 (continued)

SEQ ID NO: 321, DNA - Arabidopsis thaliana
ATGCCAAACACTAGCAGCTCTCAAAGCTTCACTATCTTCGTTGATGGTTGGTTAATCCGTCACAGG
TATTTCGTTGAACAGCTTATGTGTGCTTCTTCCTTGGATGAAACTAATCGTATCTCTCTCGAAGAA
CAACAATCTCCCGTGGCCCAGTTTCTATCTCACTGTCTTCAATACTACCAAGAGAAATTCGCCTCC
GTTTCCCTCGCCGGGGACAACGTTTTCACTTTCTTCTGCCCACCGTGGTTTAACTCCTACGCTAAA
CTTATTTTATGGGTCGGCGATTTCAAGCCTTCTCTTGTGTTTAAACTCACCGAGGTCTCCGTGGCC
GACCTCACGCGCCACCAGAAAGACCGGATCTCGAGTCTTAAGTCGGAGACTAGGAGGAAAGAGAGA
GAAGTTATGCGAGATTTCGCCCTCGTGCAACAAAGCGTGGCGGATCCGCCGGTGATGCTCGCGGCG
AGGCGCGTGGGAGCGGTGGGAATGGTGGACGGAGAAGAAACGGATTTGGAGGAGGCGATGGAGGTG
CTTAAAGCTGGGATGGCGGCAGCGATGAACAACGCTGATCAGCTACGGTGTTCGACGGTGGGGAAA
GTGGTGGAGATTCTTACTCCGCCGCAAGCGATTAAAGTGTTGAGGACAATCGGACAGCTTCACCTC
CGTCTGAGAGACAGAGACCAAGAAAGAGCTTAA

SEQ ID NO: 322, protein - Arabidopsis thaliana
MPNTSSSQSFTIFVDGWLIRHRYFVEQLMCASSLDETNRISLEEQQSLVAQFLSHCLQYYQEKFAS
VSLAGDNVFTFFCPPWFNSYAKLILWVGDFKPSLVFKLTEVSVADLTRHQKDRISSLKSETRRKER
EVMRDFALVQQSVADPPVMLAARRVGAVGMVDGEETDLEEAMEVLKAGMAAAMN**NADQLRCSTVGK
VVE**ILTPPQAIKVLRTIGQLHLRLRDRDQERA

**SEQ ID NO: 323,  gi|61742728|gb|AY954859.1| Arabidopsis thaliana
hypothetical protein (At4g18690) gene, complete cds**
ATGGCGACTAGTTCTTCGAGTTATGGGATTGAACAACTTCAAAAGGATGTTACTATGAGTGGATG
AGTGTGCAGGCTAAACACATAGTTGATCTCAAAGAAGCACTCATGAGTCATCGATCCAAAGAAGAT
CACAAGCTTGAAGAACTCGTTGGTAAAATCGTCAATGACTTCCAAAAATACACCGAAAAACGATCT
GAGCTCTCTCGCCGAAGCTGCTCAAGCTACTTTGCACCGTCGTGGAACTCTCCTCTAGAGAACGGT
TTACTATGGATGGGAGGATGTCGTCCATCGTCTTTCATTAGAGTTATTTACTCTCTTTGTGGATCC
CAAGCCGAAACGCAGCTTTCTCAGTATCTTCTAAAGATCGATGAAAATGTCGAAGTAAACCATGGT
GGTTCCATGAGTGATCTAAACGCGTCGCAGCTTGCAAAAATCAATGATTTGCATATAAAGGTTATA
GAGAAAGAGGACAAGATAACAAAGAAATCGGCGAATTTGCAAGAGAATGTTGCGGATATGCCTATA
GCCATCGCGGCTTATGCCACGGACTTGATGAATGGTGACGTGGTGGTGGAAGATGCTTTAGATAAG
TATGAGGAGGGCATGGCGGTTTTAATGGTGGAAGCTGATAAACTGAGGTTTGAGACGCTTAGGAAG
ATCGTGGATGTTGTTACGCCGGTTCAAGCGGCGGAGTTTTTGCTCGCAGGGAAAAGATTACACATA
TCATTGCACGAGTGGGGAAGAGTTAGAGAAGAGCAACGTTTTGGGTGTGTACGTACGGATGCAGCG
GCTGCCACGGGAGGAGCGGGAACCGAGAAGTCAAAGAGGTCAAGCTTGTTGATGTGA

**SEQ ID NO: 324,  gi|61742729|gb|AAX55185.1| hypothetical protein
At4g18690 [Arabidopsis thaliana]**
MATSSSSYGIEQLQKGCYYEWMSVQAKHIVDLKEALMSHRSKEDHKLEELVGKIVNDFQKYTEKRS
ELSRRSCSSYFAPSWNSPLENGLLWMGGCRPSSFIRVIYSLCGSQAETQLSQYLLKIDENVEVNHG
GSMSDLNASQLAKINDLHIKVIEKEDKITKKSANLQENVADMPIAIAAYATDLMNGDVVVEDALDK
YEEGMAVLMVEADKLRFETLRKIVDVVTPVQAAEFLLAGKRLHISLHEWGRVREEQRFGCVRTDAA
AATGGAGTEKSRSSLLM

**SEQ ID NO: 325,  gi|18415150|ref|NM_117984.1| Arabidopsis thaliana
unknown protein (AT4G18680) mRNA, complete cds**
ATGAGTTTACAAACTAAACACATAGATGATCTCAAAGAAGCACTCATGTGTCAACGAAACAACGAT
GACAAACTCGAAGACCTCGTTGGTAAAATCGTCAATGACTACCACACATATGCGGGAAAACGATCA
GAGCTCTCGTACCGATGCTGCGCTCACTACTTTGCACCGTCGTGGAACACTCCTATAGAGAACAGT

FIGURE 22

```
ATGCTATGGATGGGAGGATGTCGTCCTTCTTCTTTCATTAGACTTATATACGCACTTTGTGGATCC
CAGGCCGAAACTCAGCTTTCTCAATATCTTCTTAAGATCGATGACGACTTCGATATAAACCATGGT
GGTTTCATGAGTGATCTTACCGCGACACAGCTTGGAAAACTCAATGACTTGCATTTGGAGGTAATA
AAGAAAGAAGACAAGATTACGAAGACATCTGCGAATTTTCAAGACGATGTGGCGGATTTGCCAATC
GCGGATGTGGTGCATGCTGATGTAGCGGTGGAGGATGCTTTGGATAAGCATGAAGAGGGAATGGCG
GTTTTACTGGCGGAGGCTGATAAACTGAGGTTTGAGACGCTTAGGAAGATTGTGGACGTTGTCACA
CCGCTTCAAGCGGTGGAGTTTTTGCTTGCCGGAAAAAGATTACAGCTGTCGTTGCACGACCGGGGA
AGAGTTAGAGCAGATGTTTGTGGAGGAGTGGGGGGCGCCGCTGTCTGA
```

SEQ ID NO: 326, gi|15233977|ref|NP_193603.1| unknown protein [Arabidopsis thaliana]
```
MSLQTKHIDDLKEALMCQRNNDDKLEDLVGKIVNDYHTYAGKRSELSYRCCAHYFAPSWNTPIENS
MLWMGGCRPSSFIRLIYALCGSQAETQLSQYLLKIDDDFDINHGGFMSDLTATQLGKLNDLHLEVI
KKEDKITKTSANFQDDVADLPIADVVHADVAVEDALDKHEEGMAVLLAEADKLRFETLRKIVDVVT
PLQAVEFLLAGKRLQLSLHDRGRVRADVCGGVGGAAV
```

SEQ ID NO: 327, gi|42566935|ref|NM_117981.3| Arabidopsis thaliana unknown protein (AT4G18650) mRNA, complete cds
```
ATAGAATATAACCACTAATGAGCAAATGAGAAACCTAGTAGAAGAAAAGTTCCTAGAGTTCTATG
AGAGTTGGGTTATTCAACTTGAGCTATATCTTCATCAACTTTTAATTGCTCATAACAATAACACTA
TGAGTGAGACCGAGCTTCGACATTTGATCTCGAAGCTAACTACACATCACAAAGCTTATTATACAG
CCAAATGGGCAGCCATAAGAGAAGATGTCTTAGCTTTTTTCGGATCAGTTTGGTTAAACCCGTTAG
AGAATGCTTGCTCTTGGTTAACCGGATGGAAACCGTCGATGGTGTTTCGGATGGTTGATAGGCTGA
GGAAGTCGAGAGTGGTGCTTGTGGAGGCTCAGGTGAAGAAATTGGAGGAGCTGAGAGTTAAGACCA
AGTTCGATGAGCAAAAAATTGAGAGAGAGATGGAGCGGTATCAGGTGGCTATGGCTGATCGGAAAA
TGGTAGAGCTGGCGAGGCTTGGATGTCACGTCGGAGGAGAATCGGTGATGGTGGTGGAGGCAGCGG
TGAGAGGATTATCGATGGGTCTTGAGAAAATGGTGAAGGCTGCGGATTGTGTGCGGCTGAAAACGC
TTAAAGGTATATTAGACATTTTAACTCCACCGCAATGCGTTGAGTTTTTGGCAGCGGCGGCTACGT
TTCAGGTTCAGTTACGTCGGTGGGGAAACCGAAGACATTATGTCACTCACTCCTGACACAAACTTA
AGAGTTATTTTCTCTGTTCTGTTTTTTTTTTTTCATATTACAATAAGAATGAAATTTTTAAC
```

SEQ ID NO: 328, gi|30684489|ref|NP_193600.2| unknown protein [Arabidopsis thaliana]
```
MSKMRNLVEEKFLEFYESWVIQLELYLHQLLIAHNNNTMSETELRHLISKLTTHHKAYYTAKWAAI
REDVLAFFGSVWLNPLENACSWLTGWKPSMVFRMVDRLRKSRVVLVEAQVKKLEELRVKTKFDEQK
IEREMERYQVAMADRKMVELARLGCHVGGESVMVVEAAVRGLSMGLEKMVKAADCVRLKTLKGILD
ILTPPQCVEFLAAAATFQVQLRRWGNRRHYVTHS
```

SEQ ID NO: 329, gi|30696249|ref|NM_104613.2| Arabidopsis thaliana ZW2 (ZW2) mRNA, complete cds
```
CTTGGAACTATATATGAGTCATGCCAATCACTAGCAGCTCTGAAACTTTTGCGAGCTTCTTCAATG
ACTGGCTCTGCCGTCACAGGCAATTCGTCCAACAACTTGCACACCTTGCTGATGAAACAACCATTG
TAACTCCAATAGAAGAAGAATCTCTTGTGAGTAACTTTCTTTCTCACTATCTCCAATACTACGAAG
AGAAATCAGTTGCCATGTCCGTGGCCGGTGACGATATATGATTTCTTCTCCACCATGGCTCA
GCTCATACGAGAAACTCATCCTCTGGATCGGAGGTTTTAAACCAGGTATGGTTTTAAGCTCATAA
CCACTTCTGTTAATGACCTTACGAGCCACCAAATAGACCAACTCGAGAGCATTCGGTTAGAGACTA
AACGGAGGGAGAGAGATTTGATGCGAAGGTTCGCGCTTCTACAACAGAGCGTGGGGATCCACTTC
```

FIGURE 22 (continued)

```
TGATGGTTCCATTTAGGCGCATCGGAGTGTTGAGGCTTGGCGAAGGAGAGCAGCCAGAAATGGAGG
ATGCAATGGAGGTTTTGAAGGTAGAGATGATTAAAGCGATGAAGAACGCTGATCAACTCCGGTGTG
TGACGGTTGGGAAAGTGGTGGAGGTTCTGAATCCACGGCAGTCGATCAAGCTGCTAAGAGCCGCTG
GAGAGTTTTATCTCCGGCTGAGAGATTTAGGTGTGTAGAGAGAAACAGTTCTTTGCTAGGACTTTA
ATGTTCTTTTTTTTTTTTTTGAGTGTTCTAAGTATTTCGAAATCAGGTTTGGTCTTATAAGTGAA
CAACATTTGTTCTACAATAAAAACAAATCCGGTAGTGCTTATGTATAGGTTTGGGCTTTGGACATG
AGTTTTGTATGTAATTACGTTTCATGCCATCGTACTTTTAGTTCTCT
```

SEQ ID NO: 330, gi|18406255|ref|NP_564730.1| ZW2 [Arabidopsis thaliana]
```
MPITSSSETFASFFNDWLCRHRQFVQQLAHLADETTIVTPIEEESLVSNFLSHYLQYYEEKSVAMS
VAGDDIYDFFSPPWLSSYEKLILWIGGFKPGMVFKLITTSVNDLTSHQIDQLESIRLETKRRERDL
MRRFALLQQSVGDPLLMVPFRRIGVLRLGEGEQPEMEDAMEVLKVEMIKAMKNADQLRCVTVGKVV
EVLNPRQSIKLLRAAGEFYLRLRDLGV
```

SEQ ID NO: 331, gi|90093307|gb|BT024896.1| Arabidopsis thaliana At5g10030 mRNA, complete cds
```
ATGAATACAACCTCGACACATTTTGTTCCACCGAGAAGGTTTGAAGTTTACGAGCCTCTCAACCAA
ATCGGTATGTGGGAAGAAAGTTTCAAGAACAATGGAGACATGTATACGCCTGGCTCTATCATAATC
CCGACTAACGAAAAACCAGACAGCTTGTCAGAGGATACTTCTCATGGGACAGAAGGAACTCCTCAC
AAGTTTGACCAAGAGGCTTCCACATCTAGACATCCTGATAAGATACAGAGAAGGCTAGCACAGAAT
CGAGAGGCAGCTAGGAAAAGTCGTTTGCGCAAGAAAGCTTATGTTCAGCAGCTAGAGACTAGCCGG
TTAAAGCTAATTCATTTAGAGCAAGAACTCGATCGTGCTAGACAACAGGGGTTTCTATGTGGGGAAC
GGAGTAGATACCAATGCTCTTAGTTTCTCAGATAACATGAGCTCAGGGATTGTTGCATTTGAGATG
GAATATGGACATTGGGTGGAAGAACAGAACAGGCAAATATGTGAACTAAGAACGGTTTTACATGGA
CAAGTTAGTGATATAGAGCTTCGTTCTCTAGTCGAGAATGCCATGAAACATTACTTTCAACTCTTC
CGAATGAAGTCAGCCGCTGCAAAAATCGATGTTTTCTATGTCATGTCCGGAATGTGGAAAACTTCA
GCAGAGCGGTTTTTCTTGTGGATAGCGGATTTAGACCCTCAGAGCTTCTCAAGGTTCTGTTACCG
CATTTTGATCCTTTGACGGATCAACAACTTTTGGATGTATGTAATCTGAGGCAATCATGTCAACAA
GCAGAAGATGCGTTATCCCAAGGTATGGAGAAACTGCAACATACATTAGCAGAGAGTGTAGCAGCC
GGGAAACTTGGTGAAGGAAGTTATATTCCTCAAATGACTTGTGCTATGGAGAGATTGGAGGCTTTG
GTCAGCTTTGTAAATCAAGCTGATCATCTGAGACATGAGACATTGCAACAGATGCATCGGATCTTA
ACCACGCGACAAGCGGCTAGAGGTTTGTTAGCATTAGGGGAGTATTTCCAAAGGCTTCGAGCTTTG
AGTTCGAGTTGGGCGGCTAGGCAACGTGAACCAACGTAA
```

SEQ ID NO: 332, gi|90093308|gb|ABD85167.1| At5g10030 [Arabidopsis thaliana]
```
MNTTSTHFVPPRRFEVYEPLNQIGMWEESFKNNGDMYTPGSIIIPTNEKPDSLSEDTSHGTEGTPH
KFDQEASTSRHPDKIQRRLAQNREAARKSRLRKKAYVQQLETSRLKLIHLEQELDRARQQGFYVGN
GVDTNALSFSDNMSSGIVAFEMEYGHWVEEQNRQICELRTVLHGQVSDIELRSLVENAMKHYFQLF
RMKSAAAKIDVFYVMSGMWKTSAERFFLWIGGFRPSELLKVLLPHFDPLTDQQLLDVCNLRQSCQQ
AEDALSQGMEKLQHTLAESVAAGKLGEGSYIPQMTCAMERLEALVSFVNQADHLRHETLQQMHRIL
TTRQAARGLLALGEYFQRLRALSSSWAARQREPT
```

SEQ ID NO: 333, gi|21634|emb|X56782.1| T.aestivum 1b-c38 gene for HBP-1b (leucine zipper type transcription factor)
```
GAATTCCGGCGACGGCGGCAGTCTACTACCCCGTAGTTCGGATAGAGGCCCCTCTTCCTATCGAGT
GTTTAGGCATATATCTGCAGCTTTGTCACAACAAAGGAATCTCTCTGGGAGTTACATTGAGCACTA
TGAATAATCTGCAATGGCAGAGGCCAGCCCTAGAACAGAAACGTCAACAGATGATACTGATGAAAA
```

FIGURE 22 (continued)

```
TCTTATGCTTGAACCAGGGAATGCTGCTCTTGCTGTTGTTTCTGACTCTAGTGACAGATCCAGAGA
CAAAAACGGAGATCAAAAGACAATGCGTCGGCTTGCTCAAAATCGCGAGGCTGCTAGGAAAAGTCG
TTTGAGGAAAAAGGCATATGTTCAACAATTGGAGAACAGCAGGCTAAAGCTTACCCAGCTAGAGCA
GGAGTTGCAACGAGCTCGTCAACAAGGCATTTTTATATCTAGTTCAGCAGACCAGTCCCATTCCAT
GAGTGGAAATGGGGCGTTGGCTTTTGACACGGAGTACGCACGGTGGTTGGAAGAACACAATCGACA
AGTTAATGAGCTGAGAGCTGCAGTTAATGCTCATGCAGGCGATACTGAGCTGCGTAGTGTTGTTGA
GAAGATCATGTCACACTATGATGAGATTTTTAAGCAAAAAGGAAATGCAGCCAAAGCAGATGTCTT
TCATGTGTTATCAGGCATGTGGAAGACACCAGCTGAGAGGTGTTTCCTATGGCTTGGAGGTTTCCG
ACCTTCTGAGCTTTTAAAGCTTCTTTCGACCCAGCTTGAACCCCTAACTGAGCAGCAGCTGTCAGG
GATATGCAACCTTCAGCAATCATCACAACAAGCTGAGGATGCTCTTTCACAAGGAATGGAGGCTCT
TCAGCAGTCTTTGGCAGAAACGTTGGCTGGGTCTATCGGCTCTTCTGGATCTGGATCAACAGGAAA
TGTGGCAAACTACATGGGGCAAATGGCCATGGCCATGGGAAAGCTTGGAACCCTTGAAAATTTCCT
TAGTCAGGCTGACAACCTGCGGCAGCAGACTCTTCAGCAGATGCAAAGGATCCTGACCACAAGGCA
GTCTGCCCGTGCACTTCTTGTGATAAGTGATTACTCATCCCGGCTTCGTGCCCTAAGTTCTCTTTG
GCTTGCTCGACCGAAGGAATAACAAGCGCGTGTGATTTGACTGCAATACATTTTCGCAATTTGGGG
GTGATGGTGGTGGCAGTCATGCAACAGACTTGATTCAGAGAAACTTGCACATACTATAATCCAAAG
AGATGCTGTGTTCAGGTAGCTTAGCCATATAGTGAAGTTGAGTGCATTAGGGAAGGGTCCTTGTTG
TACCGTTAACCGCTGTAAAATTGGCATCTAATGGTTGCCAAGTAATCTTTAAGATACTAATTTGCA
GAGAGCCATCCCTTTAGATGTGCATTTATAACTCTTTTGTTGCTAATCGGAAAAAAAAAGGAGGA
AGAGCGAGCTAGGCAAGAGGCTATCGCGAAAAAGGCTGCAGAAGACAACAAGGATCAGCCCTCAAG
CTCTACCGATGCTATTATGGCTGAAGCGGAACTTACCTTAAATGCTCCTGCTGATCTTGACGCAGA
TCTACTCAAGGATGATGATGATGCTCAGCTACTACAGCAAGCACTTGCTATGTCAATGGATGAGGG
TGCTTCAGGAGCTGCAGCCGTGGCTGATGCTGCTATGGCAGAAGCTGCTGCAGATGACCAGGATTT
GGCATTGGCTCTTCAAATGTCTGTCCAGGACGCTGAGGCGGCTGGTCAATCTGATATGAGCAAAGT
GTTTGAAGACAGATCATTTGTGACATCCATCCTTAATTCGCTTCCTGGTGTTGACCCCAATGACCC
ATCTGTGAAAGATCTACTGGCATCTTTGCATGGCCAAGGAGAGCAGGAGGAGAAGAAAGATAAGGA
GGACAAGCCAGACATTTCTGAAGATGGGAAGAACTGAAGGCAATGAACATCTATTTTCTCGGAAAA
GTGCAGGCGCATGAAGTGAAGAAGATTGCCTGCATTAGCTGCTTTTACACTCGGGCTCTATGAATT
TACTTAATCCTCTTGTAACTGCGTTGATGATAACTGCCGAGAGAACTTGTATTATGTCTGCTCTCA
CGAATGCTCCTTCATGTTTGTCTTAAGTGATTACATGTTGCAAATTCATTTGTACACTTTATGTCT
GTTGAAGGTGAAATTGAACGGAATTC
```

SEQ ID NO: 334, gi|21635|emb|CAA40102.1| HBP-1b [Triticum aestivum]
MAEASPRTETSTDDTDENLMLEPGNAALAVVSDSSDRSRDKNGDQKTMRRLAQNREAARKSRLRKK
AYVQQLENSRLKLTQLEQELQRARQQGIFISSSADQSHSMSGNGALAFDTEYARWLEEHNRQVNEL
RAAVNAHAGDTELRSVVEKIMSHYDEIFKQKGNAAKADVFHVLSGMWKTPAERCFLWLGGFRPSEL
LKLLSTQLEPLTEQQLSGICNLQQSSQQAEDALSQGMEALQQSLAETLAGSIGSSGSGSTGNVANY
MGQMAMAMGKLGTLENFLSQADNLRQQTLQQMQRILTTRQSARALLVISDYSSRLRALSSLWLARP
KE

SEQ ID NO: 335, gi|115434645|ref|NM_001048616.1| Oryza sativa (japonica cultivar-group) Os01g0159000 (Os01g0159000) mRNA, complete cds
```
CTCCACCACAGGTTCAGCTCGCCTCCTCCCGTAGCCAACTTCCACGCAGAGATCGCCAACCACCAT
GCCGCCGCCGTCGCCGCACCCACCTCACCGCAACGGCAACCACGTCCCGGCGCCCTCCGGCGAGTC
GTTCGCCAAGTTCTTCGAGTGCTGGATCTCCGAGCAGTCCCGCGACCTCGCCGCGCTCCGCTCCGC
CGCGTCGGCGGCGACGAACCCCGCGGCGCCGCCCGACGACGCCGAGCTCCACCGCCTCGTCAACCG
```

FIGURE 22 (continued)

```
GGTCCTCGGCCACTACGAGCACTACTACCGGACCAAGTCCGCCGCCGCCTCCACCGACGTGCTCCG
CATGTTCTCCCCGTCGTGGACCTCCACCACCGAGAACCTCTACCTCTGGTGCGGCGGATGGCGCCC
CACTGCCGCGCTCCACCTGCTCTACTCCAAGTCCGGCGCGCAGCTCGAGACCCAGCTCCCGGTGTT
CCTCGCCGGCGGCGGCCTCGGGGCGGGCGACCTCGGCGACCTCTCCGCCGAGCAGCTCCAGGCCGC
CGACCAGCTTCAGCGGATAACCGTCAGCAAGGAACGGGAGATCGAGAACGCCGCCGCGAGTGCACA
GGAGTCGTTGGCGACGGTGAAGATGGTGGAGCTAGCCGGAGGCGGCGGGATGGACGCGGAGGGGAT
GGAGATGGAGATGAGGAGCAAGGCGGACGGGATGAGGCGCGTGCTGGAGATGGCAGACGGGCTGAG
GCTGGAGACGATGAGGGAGGTGGTGGCGCTGCTCCGCCCGTCGCAGGCCGTGCACTTCCTCATCGC
CGCCGCCGAGCTCCACCTCGCCGTGCACGAGTTCGGCAGGCGCAAGGACGGCGACGGCGCCGCGTC
GCCGCCGCCGGCGTGACGCGTGCGCGCTCGTGTCGTGTCGTTGCCGTTCCAAGTGCGCGGCGTGGT
CTCCGATGCGTAGGCTCGTCGTCTAGCTCTGGTCAACTCAAGTCGTCGCGATAAGCTTTGACCGAT
ATTTATTTATGCAGTACTCGTACACTAGTATTTCTCTCTCTCTCTTTTTTTTCTGCGATGAAGC
CGATGATACCTGTAGGGTTTTTTTTTCTTTCTTTTTGCGTTTGCATGTGATGGAATTTTACTAC
CGTACTTTGGAGCAGCTGTTTCTATATAGACAGTGAGCTAACCTGCGTGATATTTCTAATCAATTC
GGGAAGGGAAGGATAAAATTGTTTTTTGTTGCTATGTGTTCGAATCTTAATGTTAATCACACCGCT
TAACC
```

SEQ ID NO: 336, gi|115434646|ref|NP_001042081.1| Os01g0159000 [Oryza sativa (japonica cultivar-group)]
```
MPPPSPHPPHRNGNHVPAPSGESFAKFFECWISEQSRDLAALRSAASAATNPAAPPDDAELHRLVN
RVLGHYEHYYRTKSAAASTDVLRMFSPSWTSTTENLYLWCGGWRPTAALHLLYSKSGAQLETQLPV
FLAGGGLGAGDLGDLSAEQLQAADQLQRITVSKEREIENAAASAQESLATVKMVELAGGGGMDAEG
MEMEMRSKADGMRRVLEMADGLRLETMREVVALLRPSQAVHFLIAAAELHLAVHEFGRRKDGDGAA
SPPPA
```

SEQ ID NO: 337, gi|115436173|ref|NM_001049380.1| Oryza sativa (japonica cultivar-group) Os01g0306400 (Os01g0306400) mRNA, complete cds
```
ATGCGAACCCCCGCGGCGCCGTGCGCGCGCGCGTGTCCGCCGCACGCCAAGAAACCGCGCCCGATT
TATGCCGGCCCAGGGTGGGAGGGGCAAAGAATGCCGGCGTCGTACCTGCAGCCGCGCCGCGGGACG
AACGGGCGGCGTATTATGGAGCACGGCGCGGGCGAGGAGATGGTGGCGTTCTACGAGGCGTGGGTG
GGGCGCGAGGAGCGGATCGTCGCGGACCTCACGGACGCGCTCCTCCCGGCGCGGCGGCGGCGGGAC
GTGCTCGCCCCGCTCGTGGACGCCGCGGTGGGCCACGTGTCGGAGTACTACGAGCGCAAGGCCCGC
CTCGCCGACCGCGACGTGGTGGCGGCGCTGGACCCGCGCTGGCTCAACCCGCTCGAGCGCACCTTC
CTCTGGGCGTGGGGCTGGAAGCCCGCGCTGGTGTTCCGCTTCGCGGACGGCGCCGTCGCCGGCGGC
TCGTCGCACCAGCAGCAGCGCCGCGCGCTGGAGCGCGTGCGCGCCGCCACCGCGGAGGCCGAGCGG
GAGGTGGACCGGGAGGTGGCGGTCGTGCAGGAGTCGCTCGCCGGACCCCGCGTGCTGGCGGCGCTG
CGGAGGCAGCACCCGCGGAACGGCGAGGCCGACGAGGCCGTCGCCGCGGTCGGGCGCTCGCTCCGC
GTGCTGCTCGCCGCGGCCGACGCGCTCCGCGAGCGCACGGTGCGGGACGTCGTCGGGACGCTCGCG
CCAGACCAGGCCGGCGCGTTCCTCGCGGCCATGCTGAGGTTCCACCTCGGCGTGCACCGCGCCGGC
CGCAACTGGGGCTCCGGCAACGGCGGCCGGCGGGGCCTCTAG
```

SEQ ID NO: 338, gi|115436174|ref|NP_001042845.1| Os01g0306400 [Oryza sativa (japonica cultivar-group)]
```
MRTPAAPCARACPPHAKKPRPIYAGPGWEGQRMPASYLQPRRGTNGRRIMEHGAGEEMVAFYEAWV
GREERIVADLTDALLPARRRRDVLAPLVDAAVGHVSEYYERKARLADRDVVAALDPRWLNPLERTF
LWAWGWKPALVFRFADGAVAGGSSHQQQRRALERVRAATAEAEREVDREVAVVQESLAGPRVLAAL
RRQHPRNGEADEAVAAVGRSLRVLLAAADALRERTVRDVVGTLAPDQAGAFLAAMLRFHLGVHRAG
RNWGSGNGGRRGL
```

FIGURE 22 (continued)

SEQ ID NO: 339, gi|454195|dbj|D26453.1|TOBTID3 Nicotiana glauca X Nicotiana langsdorffii mRNA for tumor-related protein, complete cds, clone:tid3
CTTAAATAAATGGCTTCCTCGTTAATGAAGAGAAACGGAGTGGAAAAAAACGACAAGACGTTTCAC
GAGTTTTTTGAAACATGGCTAGCTGAGCAGAAGCAAGAATTGAAAGAGCTGGTTTCTGCCTCGAGA
GATGTAAGTAAAGGTAATAATAATGTGGTGGAAGAGAGGGTGTTGGTGCCACTCATTAAACGGGTT
ATACAACACTATGAGGGGTATTATGAGGAGAAGTCAAAATATACAGAGGAAGATGTTTTTGGGATG
TTAAATCCTACATGGAGGAGTAATCTTGAGGGAGCTTTCTTATGGATTGGAGGTTGGAGACCAAGC
ATGGCCTTTCACTTGCTCTATTCAAAATCAGGGTTGCAATTCGAAGCTCGTCTTCCCCAGTTGATT
AGAGGAATCACAACGGGTGACTTAGGGTACCTCTCTCCGGACCAAATAGATAAGGTTGATGAACTG
CAAAAGAAAACTATAAGGGAGGAAAAAAAATCGAGTGAGAAACTAGCCAGGGTTCAAGAAACTGTT
GCAGATGCATCAATGGTGGAGTTATCCCATATTGTGACTCAGCTGATGATGATTAGTGGAAGCCGA
GGAGGAGGAGGAGGAGGAGGAAAAATACTCGATGAAGAAGTGGAAGCAAATCTGGCAACAAAGGAG
GAAGGTCTAATAATAATCCTGCAAAAGGCAGATAATCTAAGGCTAAACACTCTCAAGGAAATTTTA
GCCATTTTGACACCAACTCAAGCAATTCATTTCCTGATTGCTGCTGCTGAGCTCCATTTAAGGCTT
CACGAGTGGGGCAAGATAGAGGATGCAACCGCCTCGCGAACACCAGCCCGCCGCTACTACCACCAC
CATCACCAACTTTAATCACTTGATCTAAACACACTCATCAATTGTGCTAGTTTGGGATGCCCCACT
ATTATAAGTATGATCTAGTTTGCGTTCGGTCTTATGTTAGTTTGTATGTGTGTCCACGTGCAGCAA
ATAGTACTAGTACCTAAAAATGATGGGAAAAAAAAATTAGTTTAATTTGGTTGTAGAAACATGCTT
GTTACATTTCAGAAGCCTTTCATTTGTAATAGAATTC

SEQ ID NO: 340, gi|688423|dbj|BAA05470.1| tumor-related protein [Nicotiana glauca x Nicotiana langsdorffii]
MASSLMKRNGVEKNDKTFHEFFETWLAEQKQELKELVSASRDVSKGNNNVVEERVLVPLIKRVIQH
YEGYYEEKSKYTEEDVFGMLNPTWRSNLEGAFLWIGGWRPSMAFHLLYSKSGLQFEARLPQLIRGI
TTGDLGYLSPDQIDKVDELQKKTIREEKKSSEKLARVQETVADASMVELSHIVTQLMMISGSRGGG
GGGGKILDEEVEANLATKEEGLIIILQKADNLRLNTLKEILAILTPTQAIHFLIAAAELHLRLHEW
GKIEDATASRTPARRYYHHHHQL

SEQ ID NO: 341, gi|49333382:120869-121630 Gossypium hirsutum BAC 106I22, complete sequence
ATGACGAGTCCGGTCGGTGAACGGTTCTCGGAGTTTTTTGATAAGTGGATATGTCAACTTGATGGG
TATTTACAACAGTTAGTAAGGGTGTCTAGGGAAGGTTTAAGTGAAAGTGAGCATCAAACTTTGGTT
TCGAAACTGACTGCTCATTATAAAGAATATTACACTGTTAAATGGGCAGCTGCACATGAAGATGTG
CTTGTGTTTTATTGTCCGGTTTGGTTAAGTAAGTTAGAGAATGCTTGTTCATGGTTAACCGGTTGG
AAACCGTCTATGATATTCGGTGTAGTTGAGTCAATGAGGAGGAAGAGTGTGGCTGAGTTGACGGAG
GAGCAAGTGCGAAAGATAGAACAGTTGAGGGTGAAGATAAAGTTGGAAGAAGAGAAAGTGGAAAGG
GAAATGGAGAGGCAACAAGTGGCAATGGCTGATCGGAAAATGGTTGAGTTGGTTCGTACGGCGAGG
CGGATAAGGAATGAGGAGCTGGTGGTGGTGGTTGGGAATCATCAGGTGGAGGGTTTAGTTGAAGTG
GCGCTGAAGGGTGTACTTGCAGGGCTAGAAAGGGTGATGAAAGCGGCCGATTGTGTGAGACTCAAG
GCCTTGAAAGGTGTTTTGGATGTTTTGAATCCATCACAGTCACTGGATTTCTTGGCTGGGATCTGC
ATGCTTCAGATTCAGATCAGGAAATGGGCCAAAACAGGGATAACCAAAAGGGTTCGAATCCGATA
ATATTAGGAGAACTACACAACAATGTCATTTTTTAA

SEQ ID NO: 342, gi|49333398|gb|AAT64037.1| predicted protein [Gossypium hirsutum]
MTSPVGERFSEFFDKWICQLDGYLQQLVRVSREGLSESEHQTLVSKLTAHYKEYYTVKWAAAHEDV
LVFYCPVWLSKLENACSWLTGWKPSMIFGVVESMRRKSVAELTEEQVRKIEQLRVKIKLEEEKVER

FIGURE 22 (continued)

EMERQQVAMADRKMVELVRTARRIRNEELVVVVGNHQVEGLVEVALKGVLAGLERVMKAADCVRLK
ALKGVLDVLNPSQSLDFLAGICMLQIQIRKWGQNRDNQKGSNPIILGELHNNVIF

SEQ ID NO: 343, AAX55185.1| hypothetical protein At4g18690 [Arabidopsis thaliana]
MATSSSSYGIEQLQKGCYYEWMSVQAKHIVDLKEALMSHRSKEDHKLEELVGKIVNDFQKYTEKRS
ELSRRSCSSYFAPSWNSPLENGLLWMGGCRPSSFIRVIYSLCGSQAETQLSQYLLKIDENVEVNHG
GSMSDLNASQLAKINDLHIKVIEKEDKITKKSANLQENVADMPIAIAAYATDLMNGDVVVEDALDK
YEEGMAVLMVEADKLRFETLRKIVDVVTPVQAAEFLLAGKRLHISLHEWGRVREEQRFGCVRTDAA
AATGGAGTEKSKRSSLLM

SEQ ID NO: 344, NP_193603.1| unknown protein [Arabidopsis thaliana]
MSLQTKHIDDLKEALMCQRNNDDKLEDLVGKIVNDYHTYAGKRSELSYRCCAHYFAPSWNTPIENS
MLWMGGCRPSSFIRLIYALCGSQAETQLSQYLLKIDDDFDINHGGFMSDLTATQLGKLNDLHLEVI
KKEDKITKTSANFQDDVADLPIADVVHADVAVEDALDKHEEGMAVLLAEADKLRFETLRKIVDVVT
PLQAVEFLLAGKRLQLSLHDRGRVRADVCGGVGGAAV

SEQ ID NO: 345, NP_193600.2| unknown protein [Arabidopsis thaliana]
MSKMRNLVEEKFLEFYESWVIQLELYLHQLLIAHNNNTMSETELRHLISKLTTHHKAYYTAKWAAI
REDVLAFFGSVWLNPLENACSWLTGWKPSMVFRMVDRLRKSRVVLVEAQVKKLEELRVKTKFDEQK
IEREMERYQVAMADRKMVELARLGCHVGGESVMVVEAAVRGLSMGLEKMVKAADCVRLKTLKGILD
ILTPPQCVEFLAAAATFQVQLRRWGNRRHYVTHS

SEQ ID NO: 346, P_564730.1| ZW2 [Arabidopsis thaliana]
MPITSSSETFASFFNDWLCRHRQFVQQLAHLADETTIVTPIEEESLVSNFLSHYLQYYEEKSVAMS
VAGDDIYDFFSPPWLSSYEKLILWIGGFKPGMVFKLITTSVNDLTSHQIDQLESIRLETKRRERDL
MRRFALLQQSVGDPLLMVPFRRIGVLRLGEGEQPEMEDAMEVLKVEMIKAMKNADQLRCVTVGKVV
EVLNPRQSIKLLRAAGEFYLRLRDLGV

SEQ ID NO: 347, ABD85167.1| At5g10030 [Arabidopsis thaliana]
MNTTSTHFVPPRRFEVYEPLNQIGMWEESFKNNGDMYTPGSIIIPTNEKPDSLSEDTSHGTEGTPH
KFDQEASTSRHPDKIQRRLAQNREAARKSRLRKKAYVQQLETSRLKLIHLEQELDRARQQGFYVGN
GVDTNALSFSDNMSSGIVAFEMEYGHWVEEQNRQICELRTVLHGQVSDIELRSLVENAMKHYFQLF
RMKSAAAKIDVFYVMSGMWKTSAERFFLWIGGFRPSELLKVLLPHFDPLTDQQLLDVCNLRQSCQQ
AEDALSQGMEKLQHTLAESVAAGKLGEGSYIPQMTCAMERLEALVSFVNQADHLRHETLQQMHRIL
TTRQAARGLLALGEYFQRLRALSSSWAARQREPT

SEQ ID NO: 348, CAA40102.1| HBP-1b [Triticum aestivum]
MAEASPRTETSTDDTDENLMLEPGNAALAVVSDSSDRSRDKNGDQKTMRRLAQNREAARKSRLRKK
AYVQQLENSRLKLTQLEQELQRARQQGIFISSSADQSHSMSGNGALAFDTEYARWLEEHNRQVNEL
RAAVNAHAGDTELRSVVEKIMSHYDEIFKQKGNAAKADVFHVLSGMWKTPAERCFLWLGGFRPSEL
LKLLSTQLEPLTEQQLSGICNLQQSSQQAEDALSQGMEALQQSLAETLAGSIGSSGSGSTGNVANY
MGQMAMAMGKLGTLENFLSQADNLRQQTLQQMQRILTTRQSARALLVISDYSSRLRALSSLWLARP
KE FIGURE 22 (continued)

SEQ ID NO: 349, NP_001042081.1| Os01g0159000 [Oryza sativa (japonica cultivar-group)]
MPPPSPHPPHRNGNHVPAPSGESFAKFFECWISEQSRDLAALRSAASAATNPAAPPDDAELHRLVN
RVLGHYEHYYRTKSAAASTDVLRMFSPSWTSTTENLYLWCGGWRPTAALHLLYSKSGAQLETQLPV
FLAGGGLGAGDLGDLSAEQLQAADQLQRITVSKEREIENAAASAQESLATVKMVELAGGGGMDAEG
MEMEMRSKADGMRRVLEMADGLRLETMREVVALLRPSQAVHFLIAAAELHLAVHEFGRRKDGDGAA
SPPPA

SEQ ID NO: 350, NP_001042845.1| Os01g0306400 [Oryza sativa (japonica cultivar-group)]
MRTPAAPCARACPPHAKKPRPIYAGPGWEGQRMPASYLQPRRGTNGRRIMEHGAGEEMVAFYEAWV
GREERIVADLTDALLPARRRRDVLAPLVDAAVGHVSEYYERKARLADRDVVAALDPRWLNPLERTF
LWAWGWKPALVFRFADGAVAGGSSHQQQRRALERVRAATAEAEREVDREVAVVQESLAGPRVLAAL
RRQHPRNGEADEAVAAVGRSLRVLLAAADALRERTVRDVVGTLAPDQAGAFLAAMLRFHLGVHRAG
RNWGSGNGGRRGL

SEQ ID NO: 351, BAA05470.1| tumor-related protein [Nicotiana glauca x Nicotiana langsdorffii]
MASSLMKRNGVEKNDKTFHEFFETWLAEQKQELKELVSASRDVSKGNNNVVEERVLVPLIKRVIQH
YEGYYEEKSKYTEEDVFGMLNPTWRSNLEGAFLWIGGWRPSMAFHLLYSKSGLQFEARLPQLIRGI
TTGDLGYLSPDQIDKVDELQKKTIREEKKSSEKLARVQETVADASMVELSHIVTQLMMISGSRGGG
GGGGKILDEEVEANLATKEEGLIIILQKADNLRLNTLKEILAILTPTQAIHFLIAAAELHLRLHEW
GKIEDATASRTPARRYYHHHQL

SEQ ID NO: 352, AAT64037.1| predicted protein [Gossypium hirsutum]
MTSPVGERFSEFFDKWICQLDGYLQQLVRVSREGLSESEHQTLVSKLTAHYKEYYTVKWAAAHEDV
LVFYCPVWLSKLENACSWLTGWKPSMIFGVVESMRRKSVAELTEEQVRKIEQLRVKIKLEEEKVER
EMERQQVAMADRKMVELVRTARRIRNEELVVVVGNHQVEGLVEVALKGVLAGLERVMKAADCVRLK
ALKGVLDVLNPSQSLDFLAGICMLQIQIRKWGQNRDNQKGSNPIILGELHNNVIF

SEQ ID NO: 353, Artificial sequence - primer prm09230
GGGGACAAGTTTGTACAAAAAAGCAGGCTTAAACAATGCCAAACACTAGCAGCTCT

SEQ ID NO: 354, Artificial sequence - primer prm09231
GGGGACCACTTTGTACAAGAAAGCTGGGTAGAAGCAGAGCAAAGCAAATTA

SEQ ID NO: 355, HMGP promoter
CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGGCGGGTTACCCTGGGGGTGTGGTGGATGACGGGTGGGCCCGGAGGAGGTCCGGCCC

FIGURE 22 (continued)

```
CGCGCGTCATCGCGGGGCGGGGTGTAGCGGGTGCGAAAAGGAGGCGATCGGTACGAAAATTCAAAT
TAGGAGGTGGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCCTCTCCTCTTCTCTTCT
CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGCCCTTCTCGCAGG
ATTCAGCC
```

FIGURE 22 (continued)

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2007/064510, filed Dec. 21, 2007, which claims benefit of European application 06126950.2 filed Dec. 21, 2006, European application 06126891.8 filed Dec. 21, 2006, European application 06126852.0 filed Dec. 21, 2006, European application 06127112.8 filed Dec. 22, 2006, European application 06127101.1 filed Dec. 22, 2006, U.S. Provisional application 60/883,353 filed Jan. 4, 2007, U.S. Provisional application 60/883,355 filed Jan. 4, 2007, U.S. Provisional application 60/886,105 filed Jan. 23, 2007, U.S. Provisional application 60/886,104 filed Jan. 23, 2007, and U.S. Provisional application 60/886,106 filed Jan. 23, 2007.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Second_Revised_Sequence_Listing_13987_00104_US. The size of the text file is 857 KB, and the text file was created on Dec. 8, 2012.

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding a Yield Enhancing Protein (YEP). The YEP is selected from a Vacuolar Processing Enzyme (VPE), a CCA1-like polypeptide, a SAP-like polypeptide, a Seed Yield Promoting Factor 1 (SYPF1) polypeptide and a Ribulose-1,5-bisphosphate carboxylase/oxygenase (RuBisCO) activase (RCA) polypeptide. The present invention also concerns plants having modulated expression of a nucleic acid encoding such a YEP, which plants have enhanced yield-related traits relative to control plants. The invention also provides hitherto unknown YEP-encoding nucleic acids, and constructs comprising the same, useful in performing the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as, corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

A further trait of economic importance for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. Early vigour may also result from increased plant fitness due to, for example, the plants being better adapted to their environment (i.e. being more able to cope with various abiotic or biotic stress factors). Plants having early vigour also show better establishment of the crop (with the crop growing in a more uniform manner, i.e. with the majority of plants reaching the various stages of development at substantially the same time), and show better growth and often better yield.

The ability to engineer early vigour into plants would be of great importance in agriculture, as would the ability to increase plant seed yield, whether through seed number, seed biomass, seed development, seed filling, or any other seed-related trait. Aside form the many applications in agriculture (including in the production of ornamental plants, arboriculture, horticulture and forestry), enhancing yield-related traits would also have many non-agricultural uses, such as in the biotechnological production of substances such as pharmaceuticals, antibodies or vaccines. Increasing yield may also find use in the production of algae for use in bioreactors (for the biotechnological production of substances such as pharmaceuticals, antibodies or vaccines, or for the bioconversion of organic waste) and other such areas.

Surprisingly, it has now been found that modulating expression in a plant of a nucleic acid encoding a Yield Enhancing Polypeptide (YEP) selected from a Vacuolar Processing Enzyme (VPE), a CCA1-like polypeptide, a SAP-like polypeptide, a Seed Yield Promoting Factor 1 (SYPF1) polypeptide and a Ribulose-1,5-bisphosphate carboxylase/oxygenase (RuBisCO) activase (RCA) polypeptide gives plants having enhanced yield-related traits relative to control plants.

BACKGROUND

I. Vacuolar Processing Enzymes (VPEs)

Vacuolar Processing Enzymes (VPEs) are cysteine proteases that cleave a peptide bond at the C-terminal side of asparagine and aspartic acid. VPE was originally discovered as a novel cysteine proteinase responsible for the maturation of seed storage Proteins. *Arabidopsis* has four VPE genes (alpha VPE, beta VPE, gamma VPE and delta VPE). Hara-Nishimura et al., Current Opinion in Plant Biology 2005, 8:404-408.

In higher plants, proprotein precursors of various vacuolar proteins are converted post-translationally to their respective mature forms by the action of VPEs. The molecular structure of the enzyme was originally reported for castor bean VPE. VPE homologues have been found in plants (soybean, Jack bean, *Arabidopsis*, vetch and citrus) and animals (*Schistosoma mansoni*, human and mouse). A VPE precursor is composed of a signal peptide, an N-terminal propeptide, the mature VPE domain and a C-terminal propeptide. A yeast (*Saccharomyces cerevisiae*) transformant expressing a VPE precursor of castor bean accumulated the mature form in the vacuoles. The mature protein had a vacuolar processing activity; in contrast, the precursor had no activity. Analysis of mutants having no activity suggested that the conversion of the proprotein precursor of VPE into an active form might be mediated self-catalytically. (Hiraiwa et al. FEBS Letters 447, 1999, pp. 213-216).

Programmed cell death (PCD) occurs in animals and plants under various stresses and during development. VPE was identified as an executioner of plant PCD. VPE exhibits enzymatic properties similar to that of a caspase, which is a cysteine protease that mediates the PCD pathway in animals, although there is limited sequence identity between the two enzymes. VPE was reported to have caspase-1 activity (Hatsugai et al., SCIENCE VOL 305 6 Aug. 2004). VPE and caspase-1 share several structural properties: the catalytic dyads and three amino acids forming the substrate pockets (Asp pocket) are conserved between VPE and caspase-1. In contrast to such similarities, VPE is localized in the vacuoles, while caspases are localized in the cytosol. VPE functions as a key molecule of plant PCD through disrupting the vacuole in pathogenesis and development. Hatsugai et al., Apoptosis 2006; 11: 905-911. VPE gamma (VPEg), was reported to be induced during senescence, a form of PCD (see Rojo et al., 2004, Current Biology, Vol. 14, pp 1897-1906).

II. CCA1

MYB proteins are a superfamily of transcription factors that play regulatory roles in developmental processes and defence responses in plants. Expression analysis revealed that the expression for most of the *Arabidopsis* MYB genes were responsive to one or multiple types of hormone and stress treatments (Yanhui et al., Plant Mol. Biol 60, 107-124, 2006). A phylogenetic comparison of the members of this superfamily in *Arabidopsis* and rice suggested that the *Arabidopsis* MYB superfamily underwent a rapid expansion after its divergence from monocots but before its divergence from other dicots (Yanhui et al., 2006). MYB proteins typically comprise a structurally conserved DNA-binding domain, the MYB domain. They are involved in the cell cycle, regulation of meristem formation, control of cellular differentiation and in the regulation of secondary metabolism. MYB domain transcription factors constitute one of the largest family of transcription factors in plants (at least 130 in *Arabidopsis thaliana*), but with little sequence conservation outside of the MYB domain. They have therefore been clustered into subgroups based on conserved motifs identified outside of the MYB coding region (Jiang et al. (2004) Genome Biology 5:R46). Different categories of MYB proteins can be identified depending on the number of imperfect repeats of the MYB domain they contain, grouped into 3 families: R2R3-MYB family, R1R2R3-MYB family and the MYB-related family. The R2R3-MYB family comprises the largest number of MYB proteins and is divided into five subfamilies (Yanhui et al. 2006): CCA1-like, CPC-like, TBP-like, 1-box-binding-like and R-R-type MYB proteins. Of these, the CCA1-like subfamily is the largest, and members of this subfamily contain the conserved motif SHAQK or MYADN in the MYB repeat.

The circadian clock controls various physiological and molecular processes in higher organisms. In plants, these processes include leaf movement, stomata opening, and expression of a large number of genes. In *Arabidopsis thaliana*, a number of clock-associated protein components have been identified. Among them, CCA1 (CIRCADIAN CLOCK-ASSOCIATED 1)/LHY (LATE ELONGATED HYPOCOTYL) and TOC1 (TIMING OF CAB EXPRESSION 1) are believed to be the essential components of the central oscillator. CCA1 and LHY are homologous and partially redundant Myb-related DNA-binding proteins, whereas TOC1 is a member of a small family of proteins, designated as PSEUDO-RESPONSE REGULATOR. It is also believed that these two different types of clock components form an autoregulatory positive/negative feedback loop at the levels of transcription/translation that generates intrinsic rhythms (Nakamichi et al., Plant Cell Physiol. 46, 686-689, 2005). It was reported that constitutive expression of the CCA1 (CIRCADIAN CLOCK ASSOCIATED 1) gene in *Arabidopsis* plants (CCA1-ox) results in loss of circadian rhythmicity (Green et al., Plant Physiol. 129, 576-584, 2002). These CCA1-ox plants retain the ability to respond to diurnal changes in light. Thus, transcript levels of several circadian-regulated genes, as well as CCA1 itself and the closely related LHY, oscillate robustly if CCA1-ox plants are grown under diurnal conditions. However, in contrast with wild-type plants in which transcript levels change in anticipation of the dark/light transitions, the CCA1-ox plants have lost the ability to anticipate this daily change in their environment. CCA1-ox plants flowered later, especially under long-day conditions, and were less viable under very short-day conditions than their wild-type counterparts. In addition, it was demonstrated that two other circadian rhythm mutants, LHY-ox and elf3, have low-viability phenotypes.

WO2003013228 and US2004019927 describe that CCA1 overexpressing plants were late bolting, showed increased biomass (increased leaf number and size), and were darker green in vegetative and reproductive tissues. It was suggested that CCA1 could be useful in increasing chlorophyll content allowing more growth and productivity in conditions of low light. Furthermore, it was stated that use of CCA1 to prevent flowering could help maximize vegetative yields and prevent escape of genetically modified organism (GMO) pollen (US2004045049). So far, there are no reports showing that increased CCA1 expression results increased seed yield, on the contrary, CCA1-overexpressors flowered later, especially under long-day conditions, and were less viable under very short-day conditions than their wild-type counterparts (Green et al., 2002).

III. SAP

The SAP domain (named after SAF-NB, Acinus and PIAS) is a DNA binding domain that forms a helix-extended-helix structure. Proteins with a SAP domain (also named SAF box) have been identified in yeast, mammals and plants. The SAP domain is composed of 35 amino acids residues and comprises two amphipathic helices separated by a glycine-containing region. Some positions in this domain are enriched with positively charged amino acids (R, K) which are thought to contact the DNA backbone. The SAP domain reportedly forms a helix-extended-helix (HEH) structure and that some prokaryotic proteins, such as transcription terminator RHO protein, are also predicted to contain SAP domains. Chen et al., 2003 (*Plant Molecular Biology* 52: 579-590) report that SAP domain-containing proteins have been implicated in various functions related to their interactions with DNA and/or RNA. SAP proteins have been implicated in nuclear architecture and/or RNA metabolism. For example, human scaffold attachment factor A (SAF-A) is an abundant component of the nuclear scaffold (nuclear matrix) and is also present in heterogeneous nuclear ribonucleoprotein complexes, which have been implicated in nuclear organization and RNA processing. Acinus is a caspase-3-activated protein required for apoptotic chromatin condensation. Members of the PIAS proteins family combining SAP domains and MIZ Zn-finger motifs are the protein inhibitors of activated STATs (signal transducer and activator of transcription). Yeast Tho1p protein, another SAP-containing protein, plays a role in regulating elongation of transcription by RNA polymerase II. Chen et al., 2003, describe the cloning and characterization of a rice gene, OsBP-73, encoding a 375 amino acid protein with a SAP-like domain. The authors report that Northern blot analysis demonstrated that OsBP-73 is weakly expressed in root, leaf and immature seed. They also examined OsBP-73 gene expression by histochemical studies of transgenic rice plants carrying an OsBP-73 5_/GUS reporter gene. The reporter gene was found to be mainly expressed in the tissues with high cell division activities, such as root tip, stem node, panicle and immature seed. They further report that genetic interference of OsBP-73 gene expression by double-stranded RNA inhibits the whole plant growth but does not affect the passage from the juvenile to adult phase. They suggest that OsBP-73 may play an important role in the regulation of cell proliferation.

IV. SYPF1

SYPF1 is a novel transcription factor useful in enhancing yield-related traits in plants.

Transcription factors are usually defined as proteins that show sequence-specific DNA binding and that are capable of activating and/or repressing transcription. The *Arabidopsis* genome codes for at least 1533 transcriptional regulators, which account for ~5.9% of its estimated total number of genes. About 45% of these transcription factors are reported to be from families specific to plants (Riechmann et al., 2000 (Science Vol. 290, 2105-2109)).

SYPF1, according to the PRODOM database, was found to share some similarity to tumor related At4g18650; TGA1 bzip activator coil. Miao et al., 1994 (Plant Mol Biol. April 25(1): 1-11) report that TGA1a is a well-characterized transcription factor that may mediate the root-specific and auxin-responsive expression of some plant genes.

V. Ribulose-1,5-bisphosphate Carboxylase/Oxygenase (RuBisCO) Activase (RCA) Polypeptide Ribulose-1,5-bisphosphate carboxylase/oxygenase (RuBisCo, EC 4.1.1.39 [EC]) is the most abundant and one of the most important enzymes on earth. It catalyses the first and rate-limiting step in photosynthetic carbon fixation, the irreversible carboxylation of ribulose-1,5-bisphosphate and $CO_2$ to form two 3-phosphoglyceric acid molecules. However, the rate of the reaction is extremely slow, and RuBisCo must be activated and carbamylated to become catalytically competent. Activation is achieved by RuBisCo activase (RCA), which can remove inhibitors from RuBisCo's catalytic sites, alter the conformation, and activate RuBisCo in vivo in an ATP-dependent manner (Andrews et al., 1995).

RCA is a nuclear-encoded chloroplast protein that is a member of the AAA+ family (ATPases associated with diverse cellular activities) based on sequence and structural homologies, whose members participate in macromolecular complexes that perform diverse chaperone-like functions. Consistent with the ATPase activity of RCA, a P loop (or Walker A; Walker et al., (1982) EMBO J. 1982; 1:945-951) triphosphate-binding loop consensus sequence GXXXGK(S/T), for nucleotide binding, is identified within the RCA polypeptide sequence. Several other critical amino acid residues necessary for RCA interaction with and activation of RuBisCo have also been identified (for review: Portis (2003) Photosynthesis Research 75: 11-27).

RCA consists in most plants of two isoforms, of 45-46 kDa (or alpha form) and of 41-43 kDa (or beta form), arising from a single gene via alternative splicing (for review, see Portis (2003) Photosynthesis Research 75: 11-27). The two forms differ only at the carboxy terminus, the longer form comprising two cysteine residues involved in light-dependent redox regulation (mediated by thioredoxin-f). In contrast with most plants, a single polypeptide (without the carboxy terminal extension) has been found in the green alga *Chlamydomonas reinhardtii*, which also comprises a chloroplast transit peptide at the amino terminus of the polypeptide (Roesler & Ogren (1990) Plant Physiol 94(4):1837-1841).

Mutant *Arabidopsis* plants lacking RCA activity (named rca-; Somerville et al. (1982) Plant Physiol 70: 381-387) or transgenic plants having a very low level of RCA activity cannot survive at atmospheric $CO_2$ levels (*Flaveria bidentis*; von Caemmerer et al. (2005) Plant Physiol 137(2):747-55), and those expressing reduced levels exhibit reduced rates of photosynthesis and growth (in *Arabidopsis*, Eckhardt et al. (1997) Plant Physiol 113: 575-586; in tobacco, Mate et al. (1996) Planta 198: 604-613). However large reductions in RCA activity levels are required before steady-state photosynthesis is noticeably affected, at normal temperatures (for example, *Arabidopsis*, rice (Jin et al. (2006) Ann Bot (Lond) 97(5):739-44), tobacco (He et al. (1997) Plant Physiol 115 (4):1569-80; Hammond et al. (1998) Plant J 14: 101-110).

*Arabidopsis* mutants lacking RCA (rca-) were transformed (complemented) with the alpha RCA isoform, a mutated alpha RCA isoform (the two Cys residues involved in redox regulation are mutated in Ala residues), the beta RCA isoform, or both RCA isoforms restored the ability of the plants to grow under normal levels of CO2 (Zhang et al. (2002) PNAS USA 99(5): 3330-3334). Plants expressing only the beta RCA isoform (and thus not light-dependent redox-regulated) or expressing only the mutated alpha RCA isoform (redox insensitive) were incapable of down-regulating RuBisCo under limiting light conditions.

Patent application US2006/0272044 relates to methods (by gene shuffling) for obtaining isolated polynucleotides sequences encoding RCA polypeptides having enhanced activity.

Surprisingly, it has now been found that modulating expression in a plant of a nucleic acid encoding a YEP selected from a Vacuolar Processing Enzyme (VPE), a CCA1-like polypeptide, a SAP-like polypeptide, a Seed Yield Promoting Factor 1 (SYPF1) polypeptide and a Ribulose-1, 5-bisphosphate carboxylase/oxygenase (RuBisCO) activase (RCA) polypeptide gives plants having enhanced yield-related traits relative to control plants.

DEFINITIONS

Polypeptide(s)/Protein(s)

The terms "polypeptide" and "protein" are used interchangeably herein and refer to amino acids in a polymeric form of any length.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)" are used interchangeably herein and refer to nucleotides, either ribonucleotides or deoxyribonucleotides or a combination of both, in a polymeric form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. A "control plant" as used herein refers not only to whole plants, but also to plant parts, including seeds and seed parts.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company and Table 1 below).

TABLE 1

Examples of conserved amino acid substitutions

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |

TABLE 1-continued

Examples of conserved amino acid substitutions

| Residue | Conservative Substitutions |
|---|---|
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or activity of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point (Tm) for the specific sequence at a defined ionic strength and pH. Medium stringency conditions are when the temperature is 20° C. below Tm, and high stringency conditions are when the temperature is 10° C. below Tm. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The Tm is dependent upon the solution conditions and the base composition and length of the probe. For example, longer sequences hybridise specifically at higher temperatures. The maximum rate of hybridisation is obtained from about 16° C. up to 32° C. below Tm. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:
1) DNA-DNA hybrids (Meinkoth and Wahl, Anal. Biochem., 138: 267-284, 1984):

$$Tm=81.5° C.+16.6x \log 10[Na+]^a+0.41x\%[G/C^b]-500x/L^c]-1-0.61x\% \text{ formamide}$$

2) DNA-RNA or RNA-RNA hybrids:

$$Tm=79.8+18.5(\log 10[Na+]^a)+0.58(\% G/C^b)+11.8(\% G/C^b)2-820/L^c$$

3) oligo-DNA or oligo-RNA$^d$ hybrids:

For <20 nucleotides: $Tm=2(\ln)$

For 20-35 nucleotides: $Tm=22+1.46(\ln)$ $^a$ or for other monovalent cation, but only accurate in the 0.01-0.4 M range.
$^b$ only accurate for % GC in the 30% to 75% range.
$^c$ L=length of duplex in base pairs.
$^d$ Oligo, oligonucleotide; ln, effective length of primer=2× (no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex, BMC Bioinformatics. 2005; 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (IN-DELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

Operably Linked

The term "operably linked" as used herein refers to a functional linkage between the promoter sequence and the gene of interest, such that the promoter sequence is able to initiate transcription of the gene of interest.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. Promoters able to initiate transcription in certain cells only are referred to herein as "cell-specific".

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in the table below:

Examples of Root-Specific Promoters

| Gene Source | Reference |
| --- | --- |
| RCc3 | Plant Mol Biol. 1995 Jan; 27(2): 237-48 |
| Arabidopsis PHT1 | Kovama et al., 2005; Mudge et al. (2002, Plant J. 31: 341) |
| Medicago phosphate transporter | Xiao et al., 2006 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2; 1Np (N. plumbaginifolia) | Quesada et al. (1997, Plant Mol. Biol. 34: 265) |

TABLE 2

Examples of seed-specific promoters

| Gene source | Reference |
| --- | --- |
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| Legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| Zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley ltr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| Synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-22, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| Sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | Unpublished |
| PRO0147, trypsin inhibitor ITR1 (barley) | Unpublished |

TABLE 2-continued

Examples of seed-specific promoters

| Gene source | Reference |
|---|---|
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 3

Examples of embryo-specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 4

Examples of aleurone-specific promoters:

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

Constitutive Promoter

A "constitutive promoter" refers to a promoter that is transcriptionally active during most, but not necessarily all, phases of its growth and development and under most environmental conditions, in at least one cell, tissue or organ.

TABLE 5

Examples of constitutive promoters

| Gene Source | Reference |
|---|---|
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |

TABLE 5-continued

Examples of constitutive promoters

| Gene Source | Reference |
|---|---|
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A Ubiquitous promoter is active in substantially all tissues or cells of an organism.

Green Tissue-Specific Promoter

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 6 below.

TABLE 6

Examples of green tissue-specific promoters

| Gene | Expression | Reference |
|---|---|---|
| Maize Orthophosphate dikinase | Leaf specific | Fukayama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 7 below.

TABLE 7

Examples of meristem-specific promoters

| Gene source | Expression pattern | Reference |
|---|---|---|
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luciferase system) or fluorescence (Green Fluorescent Protein, GFP, and derivatives thereof). This list represents only a small number of possible markers. The skilled worker is familiar with such markers. Different markers are preferred, depending on the organism and the selection method.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent, A F (1998). The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

TILLING (Targeted Induced Local Lesions In Genomes) is a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f)

identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J 9(10): 3077-84) but also for crop plants, for example rice (Terada et al. (2002) Nat Biotech 20(10): 1030-4; Iida and Terada (2004) Curr Opin Biotech 15(2): 132-8).

Yield

The term "yield" in general means a measurable produce of economic value, necessarily related to a specified crop, to an area, and to a period of time. Individual plant parts directly contribute to yield based on their number, size and/or weight, or the actual yield is the yield per acre for a crop and year, which is determined by dividing total production (includes both harvested and appraised production) by planted acres.

Increase/Improve/Enhance

The terms "increase", "improve" or "enhance" are interchangeable and shall mean in the sense of the application at least a 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per hectare or acre; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased yield may also result in modified architecture, or may occur because of modified architecture.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis* spp, *Artocarpus* spp., *Asparagus officinalis, Avena* spp. (e.g. *Avena sativa, Avena fatua, Avena byzantina, Avena fatua* var. *sativa, Avena hybrida*), *Averrhoa carambola, Bambusa* sp., *Benincasa hispida, Bertholletia excelsea, Beta vulgaris, Brassica* spp. (e.g. *Brassica napus, Brassica rapa* spp. [canola, oilseed rape, turnip rape]), *Cadaba farinosa, Camellia sinensis, Canna indica, Cannabis sativa, Capsicum* spp., *Carex elata, Carica papaya, Carissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium* spp., *Dimocarpus longan, Dioscorea* spp., *Diospyros* spp., *Echinochloa* spp., *Elaeis* (e.g. *Elaeis guineensis, Elaeis oleifera*), *Eleusine coracana, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja max*), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgatum, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Triticosecale rimpaui, Triticum* spp. (e.g. *Triticum aestivum, Triticum durum, Triticum turgidum, Triticum hybernum, Triticum macha, Triticum sativum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amongst others.

DETAILED DESCRIPTION OF THE INVENTION

(i) VPE

According to a first embodiment, the present invention provides a method for enhancing yield-related traits in plants relative to control plants, comprising modulating expression in a plant of a nucleic acid encoding a VPE.

The present invention also provides hitherto unknown VPE-encoding nucleic acids and VPEs. These sequences also being useful in performing the methods of the invention.

According to a further embodiment of the present invention, there is therefore provided an isolated nucleic acid molecule comprising:
  (i) a nucleic acid represented by SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171;
  (ii) the complement of any one of the SEQ ID NOs given in (i);
  (iii) a nucleic acid encoding a VPE having, in increasing order of preference, at least 70% 75%, 80%, 85%, 90%, 95%, 96%, 97%, 98%, 99% or 100% sequence identity to any one of the amino acid sequences given in SEQ ID NO: 152, SEQ ID NO: 154 and SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172;
  (iv) a nucleic acid capable of hybridizing under stringent conditions to any one of the nucleic acids given in (i), (ii) or (iii) above.

According to a further embodiment of the present invention, there is also provided an isolated polypeptide comprising:
  (i) an amino acid sequence represented by any one of SEQ ID NO: 152, SEQ ID NO: 154 and SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172;
  (ii) an amino acid sequence having, in increasing order of preference, at least at least 70%, 75%, 80%, 85%, 90%, 95%, 96%, 97%, 98%, 99% or 100% sequence identity to any one of the amino acid sequences given in SEQ ID NO: 152, SEQ ID NO: 154 and SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172;
  (iii) derivatives of any of the amino acid sequences given in (i) or (ii) above.

A preferred method for modulating (preferably, increasing) expression of a nucleic acid encoding a VPE is by introducing and expressing in a plant a nucleic acid encoding a VPE.

Any reference hereinafter to a "protein useful in the methods of the invention" is taken to mean a VPE as defined herein. Any reference hereinafter to a "nucleic acid useful in the methods of the invention" is taken to mean a nucleic acid capable of encoding such a VPE. The nucleic acid to be introduced into a plant (and therefore useful in performing the methods of the invention) is any nucleic acid encoding the type of protein which will now be described, hereafter also named "VPE nucleic acid" or "VPE gene".

A "VPE" as defined herein refers to any vacuolar processing enzyme. VPE are cysteine proteases that cleave a peptide bond at the C-terminal end of asparagine and aspartic acid (Hiraiwa et al. FEBS Letters 447, 1999, pp. 213-216).

The proteins of the invention are identifiable by the presence of the conserved domains (see FIG. 5 showing the domain structure of a gamma VPEs (VPEg)). VPEg comprise one or more of the following features:
  signal peptide for insertion into the endomembrane system;
  an N-terminal inhibitory domain;
  an active domain;
  a C-terminal inhibitory domain; and
  Conserved Histidine and Cysteine residues.

The term "domain" is defined in the "definitions section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244, InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of protein sequences is available on the ExPASY proteomics server (hosted by the Swiss Institute of Bioinformatics (Gasteiger et al., ExPASy: the proteomics server for in-depth protein knowledge and analysis, Nucleic Acids Res. 31:3784-3788 (2003)). Domains may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values, which are indicated in the Example section herein as a percentage were determined over the entire nucleic acid or amino acid sequence, and/or over selected domains or conserved motif(s), using the programs mentioned above using the default parameters.

Furthermore, VPEs (at least in their native form) typically have the following activity. Further details are provided in the Examples section herein.

The VPE represented by SEQ ID NO: 150 is an enzyme with an Enzyme Commission (EC) number EC 3.4.22.34 for ebi.ac.uk/intenz/query?cmd=Search EC&ec=3.4.22.34&status=OK legumain on the world wide web (also called asparaginyl endopeptidase). Asparaginyl endopeptidases catalyse the hydrolysis of proteins and small molecule substrates at Asn-l-Xaa- bonds. Peptidases in this class are not inhibited by compound E-64. VPEg (VPE gamma) has been shown to exhibit protease activity towards Asp residues and towards an Asp-Gin bond to remove the N-terminal propeptide (Haraiwa et al. 1999, FEBS 447: 213-216). Alternative methods to detect protease activity of VPE proteins have been reported (see for example Kuroyanagi, The Journal of Biological Chemistry Vol. 280, No. 38, pp. 32914-32920).

VPEs also typically exhibit CASPASE I activity (see Hatsugai et al., (Science VOL 305 6 Aug. 2004) and Rojo et al., 2004 (Current Biology, Vol. 14, pp 1897-1906)). The following active pentapetide site in caspases is reported: E(A/G) CES (SEQ ID NO: 209).

The present invention is illustrated by transforming plants with the nucleic acid sequence represented by SEQ ID NO: 149, encoding the polypeptide sequence of SEQ ID NO: 150. However, performance of the invention is not restricted to these sequences; the methods of the invention may advantageously be performed using any VPE-encoding nucleic acid or VPE as defined herein.

Examples of nucleic acids encoding VPEs are given in the Examples section herein. Such nucleic acids are useful in performing the methods of the invention. The amino acid sequences given in the Examples are example sequences of orthologues and paralogues of the VPE represented by SEQ ID NO: 150, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in the table in the Examples against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 149 or SEQ ID NO: 150, the second BLAST would therefore be against *Arabidopsis* sequences). The results of the first and second BLASTs are then compared. A paralogue is identified if a high-ranking hit from the first blast is from the same species as from which the query sequence is derived, a BLAST back then ideally results in the query sequence as highest hit; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table B1 of the Examples section, the terms "homologue" and "derivative" being as defined herein. Also useful in the methods of the invention are nucleic acids encoding homologues and derivatives of orthologues or paralogues of any one of the amino acid sequences given in Table B1 of the Examples section. Homologues and derivatives useful in the methods of the present invention have substantially the same biological and functional activity as the unmodified protein from which they are derived.

Further nucleic acid variants useful in practising the methods of the invention include portions of nucleic acids encoding VPEs, nucleic acids hybridising to nucleic acids encoding VPEs, splice variants of nucleic acids encoding VPEs, allelic variants of nucleic acids encoding VPEs and variants of nucleic acids encoding VPEs obtained by gene shuffling. The terms hybridising sequence, splice variant, allelic variant and gene shuffling are as described herein.

Nucleic acids encoding VPEs need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table B1 in the Examples section, or a portion of a nucleic acid encoding an orthologue, paralogue or homologue of any of the amino acid sequences given in Table B1.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode a VPE as defined herein, and have substantially the same biological activity as the amino acid sequences given in Table B1 in the Examples section. Preferably, the portion is a portion of any one of the nucleic acids given in Table B1 of the Examples section, or is a portion of a nucleic acid encoding an orthologue or paralogue of any one of the amino acid sequences given in Table B1. The portion is typically at least 800 consecutive nucleotides in length, preferably at least 1,000 consecutive nucleotides in length, more preferably at least 1,200 consecutive nucleotides in length and most preferably at least 1,500 consecutive nucleotides in length, the consecutive nucleotides being of any one of the nucleic acid sequences given in Table B1 of the Examples, or of a nucleic acid encoding an orthologue or paralogue of any one of the amino acid sequences given in Table B1. Most preferably the portion is a portion of the nucleic acid of SEQ ID NO: 149. Preferably, the portion encodes an amino acid sequence comprising (any one or more of the domains defined herein. Preferably, the portion encodes an amino acid sequence which when used in the construction of a VPE phylogenetic tree, such as the one depicted in FIG. 6, tends to cluster with the group of gamma VPEs comprising the amino acid sequence represented by SEQ ID NO: 150 rather than with any other group.

Another nucleic acid variant useful in the methods of the invention is a nucleic acid capable of hybridising, under reduced stringency conditions, preferably under stringent conditions, with a nucleic acid encoding a VPE as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table B1 of the Examples section, or comprising introducing and expressing in a plant a nucleic acid capable of hybridising to a nucleic acid encoding an orthologue, paralogue or homologue of any of the nucleic acid sequences given in Table B1 of the Examples.

Hybridising sequences useful in the methods of the invention encode a VPE as defined herein, and have substantially the same biological activity as the amino acid sequences given in Table B1 of the Examples. Preferably, the hybridising sequence is capable of hybridising to any one of the nucleic acids given in Table B1, or to a portion of any of these sequences, a portion being as defined above, or wherein the hybridising sequence is capable of hybridising to a nucleic acid encoding an orthologue or paralogue of any one of the amino acid sequences given in Table B1. Most preferably, the hybridising sequence is capable of hybridising to a nucleic acid as represented by SEQ ID NO: 149 or to a portion thereof. Preferably, the hybridising sequence encodes an amino acid sequence comprising any one or more of the motifs or domains as defined herein. Preferably, the hybridising sequence encodes an amino acid sequence which when used in the construction of a VPE phylogenetic tree, such as the one depicted in FIG. 6, tends to cluster with the group of gamma VPEs comprising the amino acid sequence represented by SEQ ID NO: 150 rather than with any other group.

Another nucleic acid variant useful in the methods of the invention is a splice variant encoding a VPE as defined hereinabove, a splice variant being as defined herein.

According to the present invention, there is provided a method for enhancing yield-related traits in plants, comprising introducing and expressing in a plant a splice variant of any one of the nucleic acid sequences given in Table B1 in the Examples, or a splice variant of a nucleic acid encoding an orthologue, paralogue or homologue of any of the amino acid sequences given in Table B1.

Preferred splice variants are splice variants of a nucleic acid represented by SEQ ID NO: 149, or a splice variant of a nucleic acid encoding an orthologue or paralogue of SEQ ID NO: 150. Preferably, the amino acid sequence encoded by the splice variant comprises any one or more of the motifs or domains as defined herein. Preferably, the amino acid sequence encoded by the splice variant, when used in the construction of a VPE phylogenetic tree, such as the one depicted in FIG. 6, tends to cluster with the group of gamma VPEs comprising the amino acid sequence represented by SEQ ID NO: 150 rather than with any other group.

Another nucleic acid variant useful in performing the methods of the invention is an allelic variant of a nucleic acid encoding a VPE as defined hereinabove, an allelic variant being as defined herein.

According to the present invention, there is provided a method for enhancing yield-related traits in plants, comprising introducing and expressing in a plant an allelic variant of any one of the nucleic acids given in Table B1 of the Examples, or comprising introducing and expressing in a plant an allelic variant of a nucleic acid encoding an orthologue, paralogue or homologue of any of the amino acid sequences given in Table B1.

The allelic variants useful in the methods of the present invention have substantially the same biological activity as the VPE of SEQ ID NO: 150 and any of the amino acids depicted in Table B1 of the Examples section. Allelic variants exist in nature, and encompassed within the methods of the present invention is the use of these natural alleles. Preferably, the allelic variant is an allelic variant of SEQ ID NO: 149 or an allelic variant of a nucleic acid encoding an orthologue or paralogue of SEQ ID NO: 150. Preferably, the amino acid encoded by the allelic variant comprises any one or more of the motifs or domains as defined herein. Preferably, the amino acid sequence encoded by the allelic variant, when used in the construction of a VPE phylogenetic tree, such as the one depicted in FIG. 6, tends to cluster with the group of gamma VPE proteins comprising the amino acid sequence represented by SEQ ID NO: 150 rather than with any other group.

Gene shuffling or directed evolution may also be used to generate variants of nucleic acids encoding VPEs as defined above; the term "gene shuffling" being as defined herein.

According to the present invention, there is provided a method for enhancing yield-related traits in plants, comprising introducing and expressing in a plant a variant of any one of the nucleic acid sequences given in Table B1 of the Example, or comprising introducing and expressing in a plant a variant of a nucleic acid encoding an orthologue, paralogue or homologue of any of the amino acid sequences given in Table B1 shown in the Examples section, which variant nucleic acid is obtained by gene shuffling.

Preferably, the variant nucleic acid obtained by gene shuffling encodes an amino acid sequence comprising any one or more of the motifs or domains as defined herein. Preferably, the amino acid sequence encoded by the variant nucleic acid obtained by gene shuffling, when used in the construction of a VPE phylogenetic tree such as the one depicted in FIG. 6, tends to cluster with the group of gamma VPEs comprising the amino acid sequence represented by SEQ ID NO: 150 rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding VPEs proteins may be derived from any natural or artificial source. The nucleic acid may be modified from its native form in composition and/or genomic environment through deliberate human manipulation. Preferably the VPE-encoding nucleic acid is from a plant, further preferably from a dicotyledonous plant, more preferably from the *brassica* family, most preferably the nucleic acid is from *Arabidopsis thaliana*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of suitable control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression, preferably increasing expression, in a plant of a nucleic acid encoding a VPE as defined herein.

Since the transgenic plants according to the present invention have increased yield, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression, preferably increasing expression, in a plant of a nucleic acid encoding a VPE as defined herein.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signaling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions increased yield relative to suitable control plants grown under comparable conditions. Therefore, according to the present invention, there is provided a method for increasing yield in plants grown under non-stress conditions or under mild drought conditions, which method comprises increasing expression in a plant of a nucleic acid encoding a VPE.

The present invention encompasses plants or parts thereof (including seeds) obtainable by the methods according to the present invention. The plants or parts thereof comprise a nucleic acid transgene encoding a VPE as defined above.

The invention also provides genetic constructs and vectors to facilitate introduction and/or expression in plants of nucleic acids encoding VPEs. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a VPE as defined above;
(b) one or more control sequences capable of driving expression of the nucleic acid sequence of (a); and optionally
(c) a transcription termination sequence.

The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter may be used to drive expression of the nucleic acid sequence. A constitutive promoter is particularly useful as is a root-specific promoter. However, particularly preferred is a seed-specific promoter. A seed-specific promoter is transcriptionally active predominantly in seed tissue, but not necessarily exclusively in seed tissue (in cases of leaky expression). The seed-specific promoter may be active during seed development and/or during germination. Seed-specific promoters are well known in the art. It should be clear that the applicability of the present invention is not restricted to the VPE-encoding nucleic acid represented by SEQ ID NO: 149, nor is the applicability of the invention restricted to expression of a VPE-encoding nucleic acid when driven by a seed-specific promoter. Examples of other seed-specific promoters which may also be used to drive expression of a VPE-encoding nucleic acid are shown in the "Definitions" section herein. Further examples of seed-specific promoters are given in Qing Qu and Takaiwa (Plant Biotechnol. J. 2, 113-125, 2004), which disclosure is incorporated by reference herein as if fully set forth.

More preferably a promoter that is transcriptionally active in the embryo and/or alerone layers of a seed. Preferably, the seed-specific promoter is a Water-Stress Inducible (WSI) promoter or a functionally equivalent promoter. More preferably, the promoter sequence is as represented by SEQ ID NO: 205. Examples of other embryo-specific promoters which may also be used to drive expression of a VPE-encoding nucleic acid are shown in the "Definitions" section herein. Examples of other alerone-specific promoters which may also be used to drive expression of a VPE-encoding nucleic acid are also shown in the "Definitions" section herein.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1,000 transcripts per cell.

Optionally, one or more terminator sequences may be used in the construct introduced into a plant. Additional regulatory elements may include transcriptional as well as translational enhancers. Those skilled in the art will be aware of terminator and enhancer sequences that may be suitable for use in performing the invention. Such sequences would be known or may readily be obtained by a person skilled in the art.

An intron sequence may also be added to the 5' untranslated region (UTR) or in the coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg, Mol. Cell Biol. 8:4395-4405 (1988); Callis et al., Genes Dev. 1:1183-1200 (1987)). Such intron enhancement of gene expression is typically greatest when placed near the 5' end of the transcription unit. Use of the maize introns Adh1-S intron 1, 2, and 6, the Bronze-1 intron are known in the art. For general information, see The Maize Handbook, Chapter 116, Freeling and Walbot, Eds., Springer, N.Y. (1994).

Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

The invention also provides a method for the production of transgenic plants having enhanced yield-related traits relative to control plants, comprising introduction and expression in a plant of any nucleic acid encoding a VPE as defined hereinabove.

More specifically, the present invention provides a method for the production of transgenic plants having increased yield, which method comprises:
  (i) introducing and expressing in a plant or plant cell a VPE-encoding nucleic acid; and
  (ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a VPE as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, sorghum and oats.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

As mentioned above, a preferred method for modulating (preferably, increasing) expression of a nucleic acid encoding a VPE is by introducing and expressing in a plant a nucleic acid encoding a VPE; however the effects of performing the method, i.e. enhancing yield-related traits may also be achieved using other well known techniques. A description of some of these techniques will now follow.

One such technique is T-DNA activation tagging (Hayashi et al. Science (1992) 1350-1353), which involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

The effects of the invention may also be reproduced using the technique of TILLING (Targeted Induced Local Lesions In Genomes); for a description of the same see the "definitions" section.

The effects of the invention may also be reproduced using homologous recombination; for a description of the same see the "definitions" section.

The present invention also encompasses use of nucleic acids encoding VPEs as described herein and use of these VPEs in enhancing any of the aforementioned yield-related traits in plants.

Nucleic acids encoding VPEs described herein, or the VPEs themselves, may find use in breeding programmes in which a DNA marker is identified which may be genetically linked to a VPE-encoding gene. The nucleic acids/genes, or the VPE proteins themselves may be used to define a molecular marker. This DNA or protein marker may then be used in breeding programmes to select plants having enhanced yield-related traits as defined hereinabove in the methods of the invention.

Allelic variants of a VPE protein-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding VPEs may also be used as probes for genetically and physically mapping the genes that they are a part of, and as markers for traits linked to those genes. Such information may be useful in plant breeding in order to develop lines with desired phenotypes. Such use of VPE-encoding nucleic acids requires only a nucleic acid sequence of at least 15 nucleotides in length. The VPE-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the VPE-encoding nucleic acids. The resulting banding patterns may then be subjected to genetic analyses using computer programs such as Map-Maker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the VPE-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

(ii) CCA1

Surprisingly, it has now been found that modulating expression in a plant of a nucleic acid encoding a CCA1-like polypeptide gives plants having enhanced yield-related traits relative to control plants, in particular increased seed yield. The particular class of CCA1-like polypeptides suitable for enhancing yield-related traits in plants is described in detail below.

The present invention provides a method for enhancing yield-related traits, in particular seed yield, in plants relative to control plants, comprising modulating expression in a plant of a nucleic acid encoding a CCA1-like polypeptide.

Any reference hereinafter to a "protein useful in the methods of the invention" is taken to mean a CCA1-like polypeptide as defined herein. Any reference hereinafter to a "nucleic acid useful in the methods of the invention" is taken to mean a nucleic acid capable of encoding such a CCA1-like polypeptide.

The terms "polypeptide" and "protein" are as defined in the Definitions section herein. The terms "polynucleotide(s)", "nucleic acid sequence(s)", "nucleotide sequence(s)" are also as defined herein. The term "Control plant" is also defined hereinabove.

A preferred method for modulating (preferably, increasing) expression of a nucleic acid encoding a protein useful in the methods of the invention is by introducing and expressing in a plant a nucleic acid encoding a protein useful in the methods of the invention as defined below.

The nucleic acid to be introduced into a plant (and therefore useful in performing the methods of the invention) is any nucleic acid encoding the type of protein which will now be described, hereafter also named "CCA1-like nucleic acid" or "CCA1-like gene". A "CCA1-like" polypeptide as defined herein refers to any MYB transcription factor of the SHAQKYF class. MYB transcription factors are well known in the art, a recent overview of MYB transcription factors in rice and *Arabidopsis thaliana* is given in Yanhui et al. (Plant Mol. Biol 60, 107-124, 2006), which disclosure is incorporated herein by reference. Transcription factors regulate gene expression and comprise at least a DNA binding domain and an activation/repression domain. The MYB DNA binding domain is usually composed of one to three imperfect repeats, each with about 52 amino acids that adopt a helix-turn-helix conformation that intercalates in the major groove of the DNA. Each MYB repeat comprises three regularly spaced tryptophan residues that participate in a hydrophobic cluster and that are postulated to be involved in the specific recognition of DNA.

CCA1-like proteins as defined herein comprise a SANT domain (defined in SMART as SM00717, InterPro IPR001005, see FIG. 1), which is involved in the recognition of a specific DNA motif, the YAAC(G/T)G sequence (wherein Y symbolises C or T).

The SANT domain preferably comprises motif 1 and/or motif 2:

Motif 1, SEQ ID NO: 141:
W(T/S)(E/D/A/P/T/R)(G/E/P/Q/D/A/N/Y)E(H/Q)(D/E/N/

R/K/Q/A/S)(K/R/L/M/T/N/Q)F(L/I/V/M)(E/D/Q/I/L/V/M/

T/A/R/H)(A/S/G)(L/I/M)(Q/H/I/K/R/S/E/D/N)(L/M/K/R/

Q/V/T)(F/Y/H/V/L/F)(D/G)(R/K/E)

Preferably, motif 1 has the sequence

W(T/S)(E/D/A)(G/E/P/Q/D/A)EH(D/E/N/R/K/Q/A)(K/R/

L)F(L/I/V)(E/D/Q/I)(A/S)(L/I)(Q/H/I/K/R)(L/M/K)(F/

Y/H)(D/G)R

More preferably, motif 1 has the sequence

WT(E/D)(E/P/Q/D)EH(D/N/K/Q)(K/R)F(L/I)(E/D/Q)AL(Q/

H/I/K/R)L(F/Y/H)(D/G)R

Most preferably motif 1 has the sequence

WTEEEHNRFIEALRLYGR

Motif 2, SEQ ID NO: 142
(F/H/Y/C/L)(V/I)(G/A/K/T/V/S/R)(S/T)(K/R)(T/N/S)

(V/T/A/P/S)(I/V/T/M/R/E/A)Q(I/V)(R/A/S)(S/M)(H/Y)

(A/Y)(Q/D)(K/Y/N)(Y/H/F)(F/K/C)(L/T/S/A/I/R/H)

Preferably, motif 2 has the sequence (F/H/Y)(V/I)(G/A)(S/T)K(T/N/S)(V/T/A)(I/V)QIRSHAQK (Y/H/F)F(L/T/S/A)

Most preferably motif 2 has the sequence

HVATKTAVQIRSHAQKFFS

Preferably, the CCA1-like protein useful in the methods of the present invention also comprises motif 3 and/or motif 4:

```
Motif 3, SEQ ID NO: 143: PP(P/Q)(R/Y/L)(P/H)(K/R/P)
Motif 4, SEQ ID NO: 144: ATVAAA(S/T)AWWA
```

Further preferably, the CCA1-like protein useful in the methods of the present invention also comprises motif 5, SEQ ID NO: 145: DRSS(C/S)GSNT A person skilled in the art could readily determine whether an amino acid sequence in question falls within the definition of a "CCA1-like" polypeptide using known techniques and software for the making of a phylogenetic tree, such as a GCG, EBI or CLUSTAL package, using default parameters. A preferred method for constructing a phylogenetic tree is the method described by Yanhui et al. (2006). Any sequence clustering within the CCA1-like subfamily as defined by Yanhui et al. would be considered to fall within the aforementioned definition of a CCA1-like polypeptide, and would be considered suitable for use in the methods of the invention.

Examples of proteins useful in the methods of the invention and nucleic acids encoding the same are as given below in table A of Example 1.

Also useful in the methods of the invention are homologues of any one of the amino acid sequences given in table A of Example 1. "Homologues" are as defined in the Definitions section hereinabove.

Also useful in the methods of the invention are derivatives of any one of the polypeptides given in table A of Example 1 or orthologues or paralogues of any of the aforementioned SEQ ID NOs. The term "derivatives" being as defined herein. Particularly preferred are derivatives of SEQ ID NO: 2 or derivatives of the polypeptides given in table A of Example 1. Derivatives useful in the methods of the present invention preferably have similar biological and functional activity as the unmodified protein from which they are derived.

The invention is illustrated by transforming plants with the *Arabidopsis thaliana* nucleic acid sequence represented by SEQ ID NO: 1, encoding the polypeptide sequence of SEQ ID NO: 2, however performance of the invention is not restricted to these sequences. The methods of the invention may advantageously be performed using any nucleic acid encoding a protein useful in the methods of the invention as defined herein, including orthologues and paralogues, such as any of the nucleic acid sequences given in table A of Example 1.

The amino acid sequences given in table A of Example 1 may be considered to be orthologues and paralogues of the CCA1-like polypeptide represented by SEQ ID NO: 2, orthologues and paralogues being as defined herein.

Orthologues and paralogues may easily be found by performing a so-called reciprocal blast search. Typically, this involves a first BLAST involving BLASTing a query sequence (for example using any of the sequences listed in table A of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence as highest hit; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Table A of Example 1 gives examples of orthologues and paralogues of the CCA1-like protein represented by SEQ ID NO 2. Further orthologues and paralogues may readily be identified using the BLAST procedure described above.

The proteins of the invention are identifiable by the presence of the conserved SANT domain and one or more of the motifs 3 to 5 (shown in FIG. 1). The term "domain" refers to a set of amino acids conserved at specific positions along an alignment of sequences of evolutionarily related proteins. While amino acids at other positions can vary between homologues, amino acids that are highly conserved at specific positions indicate amino acids that are essential in the structure, stability or activity of a protein. Identified by their high degree of conservation in aligned sequences of a family of protein homologues, they can be used as identifiers to determine if any polypeptide in question belongs to a previously identified polypeptide family (in this case, the proteins useful in the methods of the invention and nucleic acids encoding the same as defined herein).

The term "motif", "consensus sequence" and "signature" are as defined herein. The term "domain" is also defined herein.

Specialist databases also exist for the identification of domains, for example, SMART (Schultz et al. (1998) Proc. Natl. Acad. Sci. USA 95, 5857-5864; Letunic et al. (2002) Nucleic Acids Res 30, 242-244, InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of protein sequences is available on the ExPASY proteomics server (hosted by the Swiss Institute of Bioinformatics (Gasteiger et al., ExPASy: the proteomics server for in-depth protein knowledge and analysis, Nucleic Acids Res. 31:3784-3788 (2003)).

Domains may also be identified using routine techniques, such as by sequence alignment. Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains (such as the SANT domain, or one of the motifs defined above) may be used as well. The sequence identity values, which are indicated below in Example 3 as a percentage were determined over the entire nucleic acid or amino acid sequence, and/or over selected domains or conserved motif(s), using the programs mentioned above using the default parameters.

Furthermore, CCA1-like proteins (at least in their native form) typically have DNA binding activity. A person skilled in the art may easily determine the presence of DNA binding activity or transcriptional activation using routine tools and techniques. To determine the DNA binding activity of CCA1-like proteins, several assays are available (for example Current Protocols in Molecular Biology, Volumes 1 and 2, Ausubel et al. (1994), Current Protocols). In particular, a DNA binding assay for CCA1-like transcription factors using the A2 fragment of the Lhcb1*3 gene is described in Wang et al. (Plant Cell 9, 497-507, 1197). Further details are provided in Example 6.

Nucleic acids encoding proteins useful in the methods of the invention need not be full-length nucleic acids, since performance of the methods of the invention does not rely on the use of full-length nucleic acid sequences. Examples of nucleic acids suitable for use in performing the methods of the invention include the nucleic acid sequences given in table A of Example 1, but are not limited to those sequences. Nucleic acid variants may also be useful in practising the methods of the invention. Examples of such nucleic acid variants include portions of nucleic acids encoding a protein useful in the methods of the invention, nucleic acids hybridising to nucleic acids encoding a protein useful in the methods of the invention, splice variants of nucleic acids encoding a protein useful in the methods of the invention, allelic variants of nucleic acids encoding a protein useful in the methods of the invention and variants of nucleic acids encoding a protein useful in the methods of the invention that are obtained by gene shuffling. The terms portion, hybridising sequence, splice variant, allelic variant and gene shuffling will now be described.

According to the present invention, there is provided a method for enhancing yield-related traits in plants, comprising introducing and expressing in a plant a portion of any one of the nucleic acid sequences given in table A of Example 1, or a portion of a nucleic acid encoding an orthologue, paralogue or homologue of any of the amino acid sequences given in table A of Example 1.

Portions useful in the methods of the invention, encode a polypeptide falling within the definition of a nucleic acid encoding a protein useful in the methods of the invention as defined herein and having substantially the same biological activity as the amino acid sequences given in table A of Example 1. Preferably, the portion is a portion of any one of the nucleic acids given in table A of Example 1. The portion is typically at least 1200 consecutive nucleotides in length, preferably at least 1400 consecutive nucleotides in length, more preferably at least 1600 consecutive nucleotides in length and most preferably at least 1800 consecutive nucleotides in length, the consecutive nucleotides being of any one of the nucleic acid sequences given in table A of Example 1. Most preferably the portion is a portion of the nucleic acid of SEQ ID NO: 1. Preferably, the portion encodes an amino acid sequence comprising a SANT domain as defined herein.

A portion of a nucleic acid encoding a CCA1-like protein as defined herein may be prepared, for example, by making one or more deletions to the nucleic acid. The portions may be used in isolated form or they may be fused to other coding (or non coding) sequences in order to, for example, produce a protein that combines several activities. When fused to other coding sequences, the resultant polypeptide produced upon translation may be bigger than that predicted for the CCA1-like protein portion.

Another nucleic acid variant useful in the methods of the invention is a nucleic acid capable of hybridising, under reduced stringency conditions, preferably under stringent conditions, with a nucleic acid encoding a CCA1-like protein as defined herein, or with a portion as defined herein. The term "hybridisation" is as defined hereinabove.

Hybridising sequences useful in the methods of the invention, encode a polypeptide having a SANT domain (see the alignment of FIG. 2) and having substantially the same biological activity as the CCA1-like protein represented by any of the amino acid sequences given in table A of Example 1. The hybridising sequence is typically at least 1200 consecutive nucleotides in length, preferably at least 1400 consecutive nucleotides in length, more preferably at least 1600 consecutive nucleotides in length and most preferably at least 1800 consecutive nucleotides in length, the consecutive nucleotides being of any one of the nucleic acid sequences given in table A of Example 1. Preferably, the hybridising sequence is one that is capable of hybridising to any of the nucleic acids given in table A of Example 1, or to a portion of any of these sequences, a portion being as defined above. Most preferably, the hybridising sequence is capable of hybridising to a nucleic acid as represented by SEQ ID NO: 1 or to a portion thereof. Preferably, the hybridising sequence encodes an amino acid sequence comprising any one or more of the motifs or domains as defined herein.

According to the present invention, there is provided a method for enhancing yield-related traits in plants, comprising introducing and expressing in a plant a nucleic acid capable of hybridizing to any one of the nucleic acids given in the table of Example 1, or comprising introducing and expressing in a plant a nucleic acid capable of hybridising to a nucleic acid encoding an orthologue, paralogue or homologue of any of the nucleic acid sequences given in the table of Example 1.

Another nucleic acid variant useful in the methods of the invention is a splice variant encoding a CCA1-like protein as defined hereinabove, the term "splice variant" being as defined herein According to the present invention, there is provided a method for enhancing yield-related traits in plants, comprising introducing and expressing in a plant a splice variant of any one of the nucleic acid sequences given in table A of Example 1, or a splice variant of a nucleic acid encoding an orthologue, paralogue or homologue of any of the amino acid sequences given in table A of Example 1.

Preferred splice variants are splice variants of a nucleic acid represented by SEQ ID NO: 1 or a splice variant of a nucleic acid encoding an orthologue or paralogue of SEQ ID NO: 2. Preferably, the amino acid sequence encoded by the splice variant comprises any one or more of the motifs or domains as defined herein.

Another nucleic acid variant useful in performing the methods of the invention is an allelic variant of a nucleic acid encoding a CCA1-like protein as defined hereinabove, the term "alleic variant" being as defined herein. The allelic variants useful in the methods of the present invention have substantially the same biological activity as the CCA1-like protein of SEQ ID NO: 2.

According to the present invention, there is provided a method for enhancing yield-related traits in plants, comprising introducing and expressing in a plant an allelic variant of any one of the nucleic acids given in table A of Example 1, or comprising introducing and expressing in a plant an allelic variant of a nucleic acid encoding an orthologue, paralogue or homologue of any of the amino acid sequences given in table A of Example 1.

Preferably, the allelic variant is an allelic variant of SEQ ID NO: 1 or an allelic variant of a nucleic acid encoding an orthologue or paralogue of SEQ ID NO: 2. Preferably, the amino acid sequence encoded by the allelic variant comprises any one or more of the motifs or domains as defined herein.

A further nucleic acid variant useful in the methods of the invention is a nucleic acid variant encoding CCA1-like proteins as defined above, which variant is obtained by gene shuffling; "gene shuffling" or "directed evolution" are as defined herein.

According to the present invention, there is provided a method for enhancing yield-related traits in plants, comprising introducing and expressing in a plant a variant of any one of the nucleic acid sequences given in table A of Example 1, or comprising introducing and expressing in a plant a variant of a nucleic acid encoding an orthologue, paralogue or homologue of any of the amino acid sequences given in table A of Example 1, which variant nucleic acid is obtained by gene shuffling. Preferably, the variant nucleic acid obtained by gene shuffling encodes an amino acid sequence comprising any one or more of the motifs or domains as defined herein.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding CCA1-like proteins may be derived from any natural or artificial source. The nucleic acid may be modified from its native form in composition and/or genomic environment through deliberate human manipulation. Preferably the CCA1-like-encoding nucleic acid is from a plant, further preferably from a dicotyledonous plant, more preferably from the Brassicaceae family, most preferably the nucleic acid is from *Arabidopsis thaliana*.

Any reference herein to a CCA1-like protein is therefore taken to mean a CCA1-like protein as defined above. Any nucleic acid encoding such a CCA1-like protein is suitable for use in performing the methods of the invention.

The present invention also encompasses plants or parts thereof (including seeds) obtainable by the methods according to the present invention. The plants or parts thereof comprise a nucleic acid transgene encoding a CCA1-like protein as defined above.

The invention also provides genetic constructs and vectors to facilitate introduction and/or expression of the nucleic acid sequences useful in the methods according to the invention, in a plant. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising
 (a) nucleic acid encoding CCA1-like protein as defined above;
 (b) one or more control sequences capable of driving expression of the nucleic acid sequence of (a); and optionally
 (c) a transcription termination sequence.

Plants are transformed with a vector comprising the sequence of interest (i.e., a nucleic acid encoding a CCA1-like polypeptide as defined herein). The skilled artisan is well aware of the genetic elements that must be present on the vector in order to successfully transform, select and propagate host cells containing the sequence of interest. The sequence of interest is operably linked to one or more control sequences (at least to a promoter). The terms "regulatory element", "control sequence" and "promoter" are as defined hereinabove. The term "operably linked" is also as defined herein.

Advantageously, any type of promoter may be used to drive expression of the nucleic acid sequence.

The promoter may be a constitutive promoter. The term "constitutive promoter" is as defined herein, and examples of constitutive promoters are also given in the Definitions section herein. Alternatively, the promoter may be an inducible promoter, as defined in the Definitions section herein. Additionally or alternatively, the promoter may be an organ-specific or tissue-specific promoter, also as defined herein.

Preferably, the CCA1-like nucleic acid or variant thereof is operably linked to a constitutive promoter. A preferred constitutive promoter is one that is also substantially ubiquitously expressed. Further preferably the promoter is derived from a plant, more preferably a monocotyledonous plant. Most preferred is use of a GOS2 promoter (preferably from rice) (SEQ ID NO: 146). It should be clear that the applicability of the present invention is not restricted to the CCA1-like nucleic acid represented by SEQ ID NO: 1, nor is the applicability of the invention restricted to expression of a CCA1-like nucleic acid when driven by a GOS2 promoter. Examples of other constitutive promoters which may also be used to drive expression of a CCA1-like nucleic acid are shown in the Definitions section herein.

It is envisaged that the increase in yield will also be obtained when the CCA1-like nucleic acid or variant thereof is operably linked to a green-tissue specific promoter. Examples of green tissue-specific promoters are provided in the Definitions section herein.

For the identification of functionally equivalent promoters, the promoter strength and/or expression pattern of a candidate promoter may be analysed for example by operably linking the promoter to a reporter gene and assay the expression level and pattern of the reporter gene in various tissues of the plant. Suitable well-known reporter genes include for example beta-glucuronidase or beta galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500,0000 transcripts per cell. Conversely, a "strong promoter" drives expression of a coding sequence at high level, or at about 1/10 transcripts to about 1/100 transcripts to about 1/1,000 transcripts per cell.

Optionally, one or more terminator sequences may be used in the construct introduced into a plant, the term "terminator" being as defined herein. Additional regulatory elements may include transcriptional as well as translational enhancers. Those skilled in the art will be aware of terminator and enhancer sequences that may be suitable for use in performing the invention. Such sequences would be known or may readily be obtained by a person skilled in the art.

An intron sequence may also be added to the 5' untranslated region (UTR) or in the coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg, Mol. Cell Biol. 8:4395-4405 (1988); Callis et al., Genes Dev. 1:1183-1200 (1987)). Such intron enhancement of gene expression is typically greatest when placed near the 5' end of the transcription unit. Use of the maize introns Adh1-S intron 1, 2, and 6, the Bronze-1 intron are known in the art. For general information, see The Maize Handbook, Chapter 116, Freeling and Walbot, Eds., Springer, N.Y. (1994).

Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. The terms "selectable marker", "selectable marker gene" or "reporter gene" are as defined hereinabove.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

The invention also provides a method for the production of transgenic plants having enhanced yield-related traits relative to control plants, comprising introduction and expression in a plant of any nucleic acid encoding a CCA1-like protein as defined hereinabove.

For the purposes of the invention, "transgenic", "transgene" or "recombinant" are as defined in the Definitions section herein. It is envisaged that the introduction of multiple copies of a naturally-occurring expression cassette as described above would also be useful in the methods of the present invention.

More specifically, the present invention provides a method for the production of transgenic plants having increased yield, which method comprises:
(i) introducing and expressing in a plant or plant cell a CCA1-like nucleic acid or variant thereof; and
(ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation.

The term "introduction" or "transformation" is defined in the Definitions section herein. The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a CCA1-like protein as defined hereinabove. Preferred host cells according to the invention are plant cells.

Host plants for the nucleic acids or the vector used in the method according to the invention, the expression cassette or construct or vector are, in principle, advantageously all plants, which are capable of synthesizing the polypeptides used in the inventive method.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added as described above. Other control sequences (besides promoter, enhancer, silencer, intron sequences, 3'UTR and/or 5'UTR regions) may be protein and/or RNA stabilizing elements.

As mentioned above, a preferred method for modulating (preferably, increasing) expression of a nucleic acid encoding a CCA1-like protein is by introducing and expressing in a plant a nucleic acid encoding a CCA1-like protein; however the effects of performing the method, i.e. enhancing yield-related traits may also be achieved using other well known techniques. A description of some of these techniques will now follow.

One such technique is T-DNA activation tagging as defined herein. The effects of the invention may also be reproduced using the technique of TILLING (Targeted Induced Local Lesions In Genomes), which technique is defined in the Definitions section herein. The effects of the invention may also be reproduced using homologous recombination, which technique is as defined herein.

Reference herein to enhanced yield-related traits is taken to mean an increase in biomass (weight) of one or more parts of a plant, which may include aboveground (harvestable) parts and/or (harvestable) parts below ground.

In particular, such harvestable parts are seeds, and performance of the methods of the invention results in plants having increased seed yield relative to the seed yield of suitable control plants.

The term "yield" and "seed yield" are as defined herein, and the terms "increase", "improving" or "improve" are also as defined herein.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

Since the transgenic plants according to the present invention have increased yield, it is likely that these plants exhibit an increased growth rate (during at least part of their life cycle), relative to the growth rate of control plants at a corresponding stage in their life cycle. The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soy bean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression, preferably increasing expression, in a plant of a nucleic acid encoding a CCA1-like protein as defined herein.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions increased yield relative to suitable control plants grown under comparable conditions. Therefore, according to the present invention, there is provided a method for increasing yield in plants grown under non-stress conditions or under mild drought conditions, which method comprises increasing expression in a plant of a nucleic acid encoding a CCA1-like polypeptide.

In a preferred embodiment of the invention, the increase in yield and/or growth rate occurs according to the methods of the present invention under non-stress conditions.

The methods of the invention are advantageously applicable to any plant, the term "plant" being as defined herein.

According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, sorghum and oats.

The present invention also encompasses use of nucleic acids encoding the CCA1-like protein described herein and use of these CCA1-like proteins in enhancing yield-related traits in plants.

Nucleic acids encoding the CCA1-like protein described herein, or the CCA1-like proteins themselves, may find use in breeding programmes in which a DNA marker is identified which may be genetically linked to a CCA1-like-encoding gene. The nucleic acids/genes, or the CCA1-like proteins themselves may be used to define a molecular marker. This DNA or protein marker may then be used in breeding programmes to select plants having enhanced yield-related traits as defined hereinabove in the methods of the invention.

Allelic variants of a CCA1-like protein-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding CCA1-like proteins may also be used as probes for genetically and physically mapping the genes that they are a part of, and as markers for traits linked to those genes. Such information may be useful in plant breeding in order to develop lines with desired phenotypes. Such use of CCA1-like protein-encoding nucleic acids requires only a nucleic acid sequence of at least 15 nucleotides in length. The CCA1-like protein-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the CCA1-like protein-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the CCA1-like protein-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

(iii) SAP

Surprisingly, it has now been found that modulating expression in a plant of a nucleic acid encoding a SAP-like polypeptide gives plants having enhanced yield-related traits relative to control plants.

According to a first embodiment, the present invention provides a method for enhancing yield-related traits in plants relative to control plants, comprising modulating expression in a plant of a nucleic acid encoding a SAP-like polypeptide.

The present invention also provides hitherto unknown SAP-like-encoding nucleic acids and SAP-like polypeptides. These sequences also being useful in performing the methods of the invention.

According to a further embodiment of the present invention, there is therefore provided an isolated nucleic acid molecule comprising:
  (i) a nucleic acid represented by SEQ ID NO: 212, SEQ ID NO: 214, SEQ ID NO: 216, SEQ ID NO: 218, SEQ ID NO: 220, SEQ ID NO: 222, SEQ ID NO: 224 and SEQ ID NO: 226;
  (ii) the complement of any one of the SEQ ID NOs given in (i);
  (iii) a nucleic acid encoding a SAP-like polypeptide having, in increasing order of preference, at least 70%, 75%, 80%, 85%, 90%, 95%, 96%, 97%, 98%, 99% or 100% sequence identity to any one of the amino acid sequences given in SEQ ID NO: 213, SEQ ID NO: 215 and SEQ ID NO: 217, SEQ ID NO: 219, SEQ ID NO: 221, SEQ ID NO: 223, SEQ ID NO: 225 and SEQ ID NO: 227;
  (iv) a nucleic acid capable of hybridizing under stringent conditions to any one of the nucleic acids given in (i), (ii) or (iii) above.

According to a further embodiment of the present invention, there is also provided an isolated polypeptide comprising:
  (i) an amino acid sequence represented by any one of SEQ ID NO: 213, SEQ ID NO: 215 and SEQ ID NO: 217, SEQ ID NO: 219, SEQ ID NO: 221, SEQ ID NO: 223, SEQ ID NO: 225 and SEQ ID NO: 227;
  (ii) an amino acid sequence having, in increasing order of preference, at least at least 70%, 75%, 80%, 85%, 90%, 95%, 96%, 97%, 98%, 99% or 100% sequence identity to any one of the amino acid sequences given in SEQ ID NO: 213, SEQ ID NO: 215 and SEQ ID NO: 217, SEQ ID NO: 219, SEQ ID NO: 221, SEQ ID NO: 223, SEQ ID NO: 225 and SEQ ID NO: 227;
  (iii) derivatives of any of the amino acid sequences given in (i) or (ii) above.

A preferred method for modulating (preferably, increasing) expression of a nucleic acid encoding a SAP-like polypeptide is by introducing and expressing in a plant a nucleic acid encoding a SAP-like polypeptide.

Any reference hereinafter to a "protein useful in the methods of the invention" is taken to mean a SAP-like polypeptide as defined herein. Any reference hereinafter to a "nucleic acid useful in the methods of the invention" is taken to mean a nucleic acid capable of encoding such a SAP-like polypeptide. The nucleic acid to be introduced into a plant (and therefore useful in performing the methods of the invention) is any nucleic acid encoding the type of protein which will now be described, hereafter also named "SAP-like nucleic acid" or "SAP-like gene".

A "SAP-like polypeptide" as defined herein refers to any polypeptide comprising the following SAP domain:
  (i) Motif 1 (SEQ ID NO: 240): XLSSLKVXELRELAK-SRGIKGYSKMKKXELVELLS, where X is any amino acid; or
  (ii) a motif having in increasing order of preference at least 60%, 65%, 70%, 75%, 80%, 85%, 90% or 95% or more sequence identity to Motif 1; or
  (iii) A motif having in increasing order of preference at least 60%, 65%, 70%, 75%, 80%, 85%, 90%, 95% or 100% sequence identity to Motif 1 as it appears in SEQ ID NO: 211: DLSTLKVTELRELAKSRGIKGYSK-MKKNDLVELLS (SEQ ID NO: 243).

Additionally, a SAP-like polypeptide may comprise:
  (i) Motif 2 (SEQ ID NO: 241): EKxEIVELFKKVQxxL-RxRAxxKxExKxxxExAKAQxxxExx-TVDSLLxLLRKHSxDQxKK, where X is any amino acid; or
  (ii) a motif having in increasing order of preference at least 60%, 65%, 70%, 75%, 80%, 85%, 90% or 95% or more sequence identity to Motif 2; or
  (iii) A motif having in increasing order of preference at least 60%, 65%, 70%, 75%, 80%, 85%, 90%, 95% or 100% sequence identity to Motif 2 as it appears in SEQ ID NO: 211: EKEIVELFKRVQAQLRARGKG-KEEKKPEQAKAQGERGSVDSLLNLL-RKHSVDQR RK (SEQ ID NO: 244); and/or
  (iv) Motif 3 (SEQ ID NO: 242): RPxSxFxRRSPVP, where X is any amino acid; or
  (v) a motif having in increasing order of preference at least 60%, 65%, 70%, 75%, 80%, 85%, 90%, 95% or more sequence identity to Motif 3;
  (vi) A motif having in increasing order of preference at least 60%, 65%, 70%, 75%, 80%, 85%, 90%, 95% or 100% sequence identity to Motif 3 as it appears in SEQ ID NO: 211: RPASNFRRRSPVP (SEQ ID NO: 245).

The term "domain" and "motif" is defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244, InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of protein sequences is available on the ExPASY proteomics server (hosted by the Swiss Institute of Bioinformatics (Gasteiger et al., ExPASy: the proteomics server for in-depth protein knowledge and analysis, Nucleic Acids Res. 31:3784-3788 (2003)). Domains may also be identified using routine techniques, such as by sequence alignment.

Methods for the alignment of sequences for comparison are well known in the art, such methods include GAP, BEST-FIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values, which are indicated below in the Example section as a percentage were determined over the entire nucleic acid or amino acid sequence, and/or over selected domains or conserved motif(s), using the programs mentioned above using the default parameters.

Furthermore, SAP-like polypeptides (at least in their native form) typically have DNA-binding activity. Tools and techniques for measuring DNA-binding activity are well known in the art; one such example is given in the Examples section herein.

The present invention is illustrated by transforming plants with the nucleic acid sequence represented by SEQ ID NO: 210, encoding the polypeptide sequence of SEQ ID NO: 211. However, performance of the invention is not restricted to these sequences; the methods of the invention may advantageously be performed using any SAP-like-encoding nucleic acid or SAP-like polypeptide as defined herein.

Examples of nucleic acids encoding SAP-like polypeptides are given in Table C1 herein. Such nucleic acids are useful in performing the methods of the invention. The amino acid sequences given in Table C1 are example sequences of orthologues and paralogues of the SAP-like polypeptide represented by SEQ ID NO: 211, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table C1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 210 or SEQ ID NO: 211, the second BLAST would therefore be against rice sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table C1, the terms "homologue" and "derivative" being as defined herein. Also useful in the methods of the invention are nucleic acids encoding homologues and derivatives of orthologues or paralogues of any one of the amino acid sequences given in Table C1. Homologues and derivatives useful in the methods of the present invention have substantially the same biological and functional activity as the unmodified protein from which they are derived.

Further nucleic acid variants useful in practising the methods of the invention include portions of nucleic acids encoding SAP-like polypeptides, nucleic acids hybridising to nucleic acids encoding SAP-like polypeptides, splice variants of nucleic acids encoding SAP-like polypeptides, allelic variants of nucleic acids encoding SAP-like polypeptides and variants of nucleic acids encoding SAP-like polypeptides obtained by gene shuffling. The terms hybridising sequence, splice variant, allelic variant and gene shuffling are as described herein.

Nucleic acids encoding SAP-like polypeptides need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table C1 in the Examples section herein, or a portion of a nucleic acid encoding an orthologue, paralogue or homologue of any of the amino acid sequences given in Table C1.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode a SAP-like polypeptides as defined herein, and have substantially the same biological activity as the amino acid sequences given in Table C1. Preferably, the portion is a portion of any one of the nucleic acids given in Table C1, or is a portion of a nucleic acid encoding an orthologue or paralogue of any one of the amino acid sequences given in Table C1. In order to perform the methods of the invention, the portion need only encode a SAP domain as defined herein, i.e. encode:
 (a) Motif 1 (SEQ ID NO: 240): XLSSLKVXELRELAKSRGIKGYSKMKKXELVELLS, where X is any amino acid; or
 (b) a motif having in increasing order of preference at least 60%, 65%, 70%, 75%, 80%, 85%, 90% or 95% or more sequence identity to Motif 1; or (c) A motif having in increasing order of preference at least 60%, 65%, 70%, 75%, 80%, 85%, 90%, 95% or 100% sequence identity to Motif 1 as it appears in SEQ ID NO: 211: DLSTLKVTELRELAKSRGIKGYSK-MKKNDLVELLS (SEQ ID NO: 243).

The portion therefore need only be around 100 consecutive nucleotides in length, so long as those 100 consecutive nucleotides encode a SAP domain as defined herein. Preferably, the portion encodes a polypeptide comprising the SAP domain as defined herein and Motifs 2 and Motifs 3 as defined herein. Preferably the portion is, in increasing order of preference at least 200, 300, 400, 500, 600, 700, 800, 900, 1,000, 1,100 consecutive nucleotides in length, the consecutive nucleotides being of any one of the nucleic acid sequences given in Table C1, or of a nucleic acid encoding an orthologue or paralogue of any one of the amino acid sequences given in Table C1. Most preferably the portion is a portion of the nucleic acid of SEQ ID NO: 210. Preferably, the portion encodes an amino acid sequence comprising (any one or more of the domains defined herein). Preferably, the portion encodes an amino acid sequence which when used in the construction of a phylogenetic tree, such as the one depicted in FIG. 10, tends to cluster with the group of SAP-like polypeptides comprising the amino acid sequence represented by SEQ ID NO: 211 rather than with any other group.

Another nucleic acid variant useful in the methods of the invention is a nucleic acid capable of hybridising, under reduced stringency conditions, preferably under stringent conditions, with a nucleic acid encoding a SAP-like polypeptide as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table C1, or comprising introducing and expressing in a plant a nucleic acid capable of hybridising to a nucleic acid encoding an orthologue, paralogue or homologue of any of the nucleic acid sequences given in Table C1.

Hybridising sequences useful in the methods of the invention encode a SAP-like polypeptide as defined herein, and have substantially the same biological activity as the amino acid sequences given in Table C1. Preferably, the hybridising sequence is capable of hybridising to any one of the nucleic acids given in Table C1, or to a portion of any of these sequences, a portion being as defined above, or wherein the hybridising sequence is capable of hybridising to a nucleic acid encoding an orthologue or paralogue of any one of the amino acid sequences given in Table C1. Most preferably, the hybridising sequence is capable of hybridising to a nucleic acid as represented by SEQ ID NO: 210 or to a portion thereof. Preferably, the hybridising sequence encodes an amino acid sequence comprising any one or more of the motifs or domains as defined herein. In order to perform the methods of the invention, the hybridising sequence need only encode a SAP domain as defined herein, i.e. encode:

(a) Motif 1 (SEQ ID NO: 240): XLSSLKVXELRELAK-SRGIKGYSKMKKXELVELLS, where X is any amino acid; or (b) a motif having in increasing order of preference at least 60%, 65%, 70%, 75%, 80%, 85%, 90% or 95% or more sequence identity to Motif 1; or (c) A motif having in increasing order of preference at least 60%, 65%, 70%, 75%, 80%, 85%, 90%, 95% or 100% sequence identity to Motif 1 as it appears in SEQ ID NO: 211: DLSTLKVTELRELAKSRGIKGYSK-MKKNDLVELLS (SEQ ID NO: 243).

Preferably, the hybridising sequence encodes an amino acid sequence which when used in the construction of a phylogenetic tree, such as the one depicted in FIG. 10, tends to cluster with the group of SAP-like polypeptides comprising the amino acid sequence represented by SEQ ID NO: 211 rather than with any other group.

Another nucleic acid variant useful in the methods of the invention is a splice variant encoding a SAP-like polypeptide as defined hereinabove, a splice variant being as defined herein.

According to the present invention, there is provided a method for enhancing yield-related traits in plants, comprising introducing and expressing in a plant a splice variant of any one of the nucleic acid sequences given in Table C1, or a splice variant of a nucleic acid encoding an orthologue, paralogue or homologue of any of the amino acid sequences given in Table C1.

Preferred splice variants are splice variants of a nucleic acid represented by SEQ ID NO: 210, or a splice variant of a nucleic acid encoding an orthologue or paralogue of SEQ ID NO: 211. Preferably, the amino acid sequence encoded by the splice variant comprises any one or more of the motifs or domains as defined herein. In order to perform the methods of the invention, the splice variant need only encode a SAP domain as defined herein. Preferably, the amino acid sequence encoded by the splice variant, when used in the construction of a phylogenetic tree, such as the one depicted in FIG. 10, tends to cluster with the group of SAP-like polypeptides comprising the amino acid sequence represented by SEQ ID NO: 211 rather than with any other group.

Another nucleic acid variant useful in performing the methods of the invention is an allelic variant of a nucleic acid encoding a SAP-like polypeptide as defined hereinabove, an allelic variant being as defined herein.

According to the present invention, there is provided a method for enhancing yield-related traits in plants, comprising introducing and expressing in a plant an allelic variant of any one of the nucleic acids given in Table C1, or comprising introducing and expressing in a plant an allelic variant of a nucleic acid encoding an orthologue, paralogue or homologue of any of the amino acid sequences given in Table C1.

The allelic variants useful in the methods of the present invention have substantially the same biological activity as the SAP-like polypeptide of SEQ ID NO: 211 and any of the amino acids depicted in Table C1. Allelic variants exist in nature, and encompassed within the methods of the present invention is the use of these natural alleles. Preferably, the allelic variant is an allelic variant of SEQ ID NO: 210 or an allelic variant of a nucleic acid encoding an orthologue or paralogue of SEQ ID NO: 211. Preferably, the amino acid encoded by the allelic variant comprises any one or more of the motifs or domains as defined herein. In order to perform the methods of the invention, the allelic variant need only encode a SAP domain as defined herein. Preferably, the amino acid sequence encoded by the allelic variant, when used in the construction of a phylogenetic tree, such as the one depicted in FIG. 10, tends to cluster with the group of SAP-like polypeptides comprising the amino acid sequence represented by SEQ ID NO: 211 rather than with any other group.

Gene shuffling or directed evolution may also be used to generate variants of nucleic acids encoding SAP-like polypeptides as defined above; the term "gene shuffling" being as defined herein.

According to the present invention, there is provided a method for enhancing yield-related traits in plants, comprising introducing and expressing in a plant a variant of any one of the nucleic acid sequences given in Table C1, or comprising introducing and expressing in a plant a variant of a nucleic acid encoding an orthologue, paralogue or homologue of any of the amino acid sequences given in Table C1, which variant nucleic acid is obtained by gene shuffling.

Preferably, the variant nucleic acid obtained by gene shuffling encodes an amino acid sequence comprising any one or more of the motifs or domains as defined herein. In order to perform the methods of the invention, the variant nucleic acid need only encode a SAP domain as defined herein. Preferably, the amino acid sequence encoded by the variant nucleic acid obtained by gene shuffling, when used in the construction of a phylogenetic tree such as the one depicted in FIG. 10, tends to cluster with the group of SAP-like polypeptides comprising the amino acid sequence represented by SEQ ID NO: 211 rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding SAP-like polypeptides may be derived from any natural or artificial source. The nucleic acid may be modified from its native form in composition and/or genomic environment through deliberate human manipulation. Preferably the SAP-like polypeptide-encoding nucleic acid is from a plant, further preferably from a monocotyledonous plant, more preferably from the family poaceae, most preferably the nucleic acid is from *Oryza sativa*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of suitable control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression, preferably increasing expression, in a plant of a nucleic acid encoding a SAP-like polypeptide as defined herein.

Since the transgenic plants according to the present invention have increased yield, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression, preferably increasing expression, in a plant of a nucleic acid encoding a SAP-like polypeptide as defined herein.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signaling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions increased yield relative to suitable control plants grown under comparable conditions. Therefore, according to the present invention, there is provided a method for increasing yield in plants grown under non-stress conditions or under mild drought conditions, which method comprises increasing expression in a plant of a nucleic acid encoding a SAP-like polypeptide.

The present invention encompasses plants or parts thereof (including seeds) obtainable by the methods according to the present invention. The plants or parts thereof comprise a nucleic acid transgene encoding a SAP-like polypeptide as defined above.

The invention also provides genetic constructs and vectors to facilitate introduction and/or expression in plants of nucleic acids encoding SAP-like polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
 (a) a nucleic acid encoding a SAP-like polypeptide as defined above;
 (b) one or more control sequences capable of driving expression of the nucleic acid sequence of (a); and optionally
 (c) a transcription termination sequence.

The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter may be used to drive expression of the nucleic acid sequence. A constitutive promoter is particularly useful in the methods, as is a tissue-specific promoter. In particular, the tissue-specific promoter is a root-specific promoter or a young green tissue-specific promoter. See the "Definitions" section herein for definitions of the various promoter types. It should be clear that the applicability of the present invention is not restricted to the SAP-like polypeptide-encoding nucleic acid represented by SEQ ID NO: 210, nor is the applicability of the invention restricted to expression of a SAP-like polypeptide-encoding nucleic acid when driven by a constitutive promoter, a root-specific promoter or a young green tissue-specific promoter.

The young green tissue-specific promoter is preferably a protochlorophyllide reductase (PcR) promoter. Examples of other young green tissue-specific promoters which may also be used to drive expression of a SAP-like-encoding nucleic acid are shown in Table 6 in the "Definitions" section herein. The constitutive promoter is preferably a GOS2 promoter, preferably a GOS2 promoter from rice. See Table 6 in the "Definitions" section herein for further examples of constitutive promoters. The root-specific promoter is preferably an RCC3 promoter, preferably an RCC3 promoter (Plant Mol Biol. 1995 January; 27(2):237-48), more preferably an RCC3 promoter from rice, further preferably as represented by a nucleic acid sequence substantially similar to SEQ ID NO: 246, most preferably the promoter is as represented by SEQ ID NO: 246. See the "Definitions" section for further examples of root-specific promoters.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1,000 transcripts per cell.

Optionally, one or more terminator sequences may be used in the construct introduced into a plant. Additional regulatory elements may include transcriptional as well as translational enhancers. Those skilled in the art will be aware of terminator and enhancer sequences that may be suitable for use in performing the invention. Such sequences would be known or may readily be obtained by a person skilled in the art.

An intron sequence may also be added to the 5' untranslated region (UTR) or in the coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg, Mol. Cell Biol. 8:4395-4405 (1988); Callis et al., Genes Dev. 1:1183-1200 (1987)). Such intron enhancement of gene expression is typically greatest when placed near the 5' end of the transcription unit. Use of the maize introns Adh1-S intron 1, 2, and 6, the Bronze-1 intron are known in the art. For general information, see The Maize Handbook, Chapter 116, Freeling and Walbot, Eds., Springer, N.Y. (1994).

Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

The invention also provides a method for the production of transgenic plants having enhanced yield-related traits relative to control plants, comprising introduction and expression in a plant of any nucleic acid encoding a SAP-like polypeptide as defined hereinabove.

More specifically, the present invention provides a method for the production of transgenic plants having increased yield, which method comprises:

(i) introducing and expressing in a plant or plant cell a SAP-like polypeptide-encoding nucleic acid; and
 (ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a SAP-like polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, sorghum and oats.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

As mentioned above, a preferred method for modulating (preferably, increasing) expression of a nucleic acid encoding a SAP-like polypeptide is by introducing and expressing in a plant a nucleic acid encoding a SAP-like polypeptide; however the effects of performing the method, i.e. enhancing yield-related traits may also be achieved using other well known techniques. A description of some of these techniques will now follow.

One such technique is T-DNA activation tagging (Hayashi et al. Science (1992) 1350-1353), which involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

The effects of the invention may also be reproduced using the technique of TILLING (Targeted Induced Local Lesions In Genomes); for a description of the same see the "definitions" section. The effects of the invention may also be reproduced using homologous recombination; for a description of the same see the "definitions" section.

The present invention also encompasses use of nucleic acids encoding SAP-like polypeptides as described herein and use of these SAP-like polypeptide in enhancing any of the aforementioned yield-related traits in plants.

Nucleic acids encoding SAP-like polypeptide described herein, or the SAP-like polypeptides themselves, may find use in breeding programmes in which a DNA marker is identified which may be genetically linked to a SAP-like polypeptide-encoding gene. The nucleic acids/genes, or the SAP-like polypeptides themselves may be used to define a molecular marker. This DNA or protein marker may then be used in breeding programmes to select plants having enhanced yield-related traits as defined hereinabove in the methods of the invention.

Allelic variants of a SAP-like polypeptide-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding SAP-like polypeptides may also be used as probes for genetically and physically mapping the genes that they are a part of, and as markers for traits linked to those genes. Such information may be useful in plant breeding in order to develop lines with desired phenotypes. Such use of SAP-like polypeptide-encoding nucleic acids requires only a nucleic acid sequence of at least 15 nucleotides in length. The SAP-like polypeptide-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the SAP-like-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the SAP-like polypeptide-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

(iv) SYPF1

Surprisingly, it has now been found that modulating expression in a plant of a nucleic acid encoding a SYPF1 polypeptide gives plants having enhanced yield-related traits relative to control plants.

According to a first embodiment, the present invention provides a method for enhancing yield-related traits in plants relative to control plants, comprising modulating expression in a plant of a nucleic acid encoding a SYPF1 polypeptide.

A preferred method for modulating (preferably, increasing) expression of a nucleic acid encoding a SYPF1 polypeptide is by introducing and expressing in a plant a nucleic acid encoding a SYPF1 polypeptide.

Any reference hereinafter to a "protein useful in the methods of the invention" is taken to mean a SYPF1 polypeptide as defined herein. Any reference hereinafter to a "nucleic acid useful in the methods of the invention" is taken to mean a nucleic acid capable of encoding such a SYPF1 polypeptide. The nucleic acid to be introduced into a plant (and therefore useful in performing the methods of the invention) is any nucleic acid encoding the type of protein which will now be described, hereafter also named "SYPF1 nucleic acid" or "SYPF1 gene".

A "SYPF1 polypeptide" as defined herein refers to any polypeptide having, in increasing order of preference, at least 40%, 45%, 50%, 55%, 60%, 65%, 70%, 75%, 80%, 85%, 90%, 95% or more sequence identity to any one, preferably to any two, most preferably to all three of Motifs I, II and III as shown in the alignment of FIG. 19. The boxed regions represent conserved regions or motifs found in SYPF1 polypeptides.

A SYPF1 polypeptide may comprise any one, preferably any two, most preferably all three of Motifs I, II and III as shown in the alignment of FIG. 19, which Motifs comprise any conservative amino acid change at any position.

A SYPF1 polypeptide may comprise any one, preferably any two, most preferably all three of Motifs I, II and III as shown in the alignment of FIG. 19.

The Motifs are preferably as found in the sequence of SEQ ID NO: 322 or in the corresponding rice orthologue (SEQ ID NO: 336), i.e.

```
Motif 1:
SLVSNFLSHYLQYYEEKS (as found in SEQ ID NO: 322)

RLVNRVLGHYEHYYRTK (as found in SEQ ID NO: 336)
```

The Motifs may comprise any conservative amino acid change at any position.

The Motifs may comprise between one and nine non-conservative amino acid changes at any position.

```
Motif 2:
PPWLSSYEKLILWIGGFKP (as found in SEQ ID NO: 322)

PSWTSTTENLYLWCGGWRP (as found in SEQ ID NO: 336)
```

The Motifs may comprise any conservative amino acid change at any position.

The Motifs may comprise between one and ten non-conservative amino acid changes at any position.

```
Motif 3:
NADQLRCVTVGKVVEVLNPRQSIKLLRA (as found in SEQ ID
NO: 322)

MADGLRLETMREVVALLRPSQAVHFLIA (as found in SEQ ID
NO: 336)
```

The Motifs may comprise any conservative amino acid change at any position.

The Motifs may comprise between one and fourteen non-conservative amino acid changes at any position.

Additionally or alternatively, the "SYPF1 polypeptide" as defined herein comprises in increasing order of preference at least 45%, 50%, 55%, 60%, 65%, 70%, 75%, 80%, 85%, 90%, 95% or more sequence identity to the SYPF1 polypeptide represented by SEQ ID NO: 322 or to any of the amino acid sequences given in Table E1 herein.

Furthermore, SYPF1 polypeptides (at least in their native form) may have DNA-binding activity. Tools and techniques for measuring DNA-binding activity are well known in the art.

The terms "domain" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244, InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of protein sequences is available on the ExPASY proteomics server (hosted by the Swiss Institute of Bioinformatics (Gasteiger et al., ExPASy: the proteomics server for in-depth protein knowledge and analysis, Nucleic Acids Res. 31:3784-3788 (2003)). Domains may also be identified using routine techniques, such as by sequence alignment.

Analysis of the polypeptide sequence of SEQ ID NO: 322 in the SMART database, revealed there to be four domains of so-called intrinsic disorder (See FIG. 18). These domains are R-, K-, S-rich and may point to a role in protein-protein interactions. The four domains are:

```
1st Domain of intrinsic disorder:
MPNTSSSQSF

2nd Domain of intrinsic disorder:
VSVADLTRHQKDRISSLKSETRRKEREV

3rd Domain of intrinsic disorder:
LVQQSVADPPVM

4th Domain of intrinsic disorder:
HLRLRDRDQERA
```

Such domains of intrinsic disorder may also be found in the corresponding rice orthologue of SEQ ID NO: 336 (NP_909348)

```
1st Domain of intrinsic disorder:
PPPSPHPPH

2nd Domain of intrinsic disorder:
SRDLAALRSAASAATNPAAPPDDA

3rd Domain of intrinsic disorder:
LAGGGLGAGDLGDL

4th Domain of intrinsic disorder:
ELAGGGGMDAEGMEMEM
```

Furthermore, analysis of the polypeptide sequence of SEQ ID NO: 322 in the PRODOM database revealed there to be similarity to: tumour related At4g18650; TGA1 bzip activator coil coil.

Furthermore, SYPF1 polypeptides comprise F-rich (phenylalanine-rich) and C-rich (cysteine-rich) regions. These regions are highlighted in FIG. 18 showing the sequence of SEQ ID NO: 322.

Methods for the alignment of sequences for comparison are well known in the art, such methods include GAP, BEST-FIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values, which are indicated below in the Examples section herein as a percentage were determined over the entire nucleic acid or amino acid sequence, and/or over selected domains or conserved motif(s), using the programs mentioned above using the default parameters.

The present invention is illustrated by transforming plants with the nucleic acid sequence represented by SEQ ID NO: 321, encoding the polypeptide sequence of SEQ ID NO: 322. However, performance of the invention is not restricted to these sequences; the methods of the invention may advantageously be performed using any SYPF1-encoding nucleic acid or SYPF1 polypeptides as defined herein.

Examples of nucleic acids encoding SYPF1 polypeptides are given in Table E1 herein. Such nucleic acids are useful in performing the methods of the invention. The amino acid sequences given in Table E1 are example sequences of orthologues and paralogues of the SYPF1 polypeptides represented by SEQ ID NO: 322, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table E1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 321 or SEQ ID NO: 322, the second BLAST would therefore be against *Arabidopsis* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table E1, the terms "homologue" and "derivative" being as defined herein. Also useful in the methods of the invention are nucleic acids encoding homologues and derivatives of orthologues or paralogues of any one of the amino acid sequences given in Table E1. Homologues and derivatives useful in the methods of the present invention have substantially the same biological and functional activity as the unmodified protein from which they are derived.

Further nucleic acid variants useful in practising the methods of the invention include portions of nucleic acids encoding SYPF1 polypeptides, nucleic acids hybridising to nucleic acids encoding SYPF1 polypeptides, splice variants of nucleic acids encoding SYPF1 polypeptides, allelic variants of nucleic acids encoding SYPF1 polypeptides and variants of nucleic acids encoding SYPF1 polypeptides obtained by gene shuffling. The terms hybridising sequence, splice variant, allelic variant and gene shuffling are as described herein.

Nucleic acids encoding SYPF1 polypeptides need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table E1, or a portion of a nucleic acid encoding an orthologue, paralogue or homologue of any of the amino acid sequences given in Table E1.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode a SYPF1 polypeptides as defined herein, and have substantially the same biological activity as the amino acid sequences given in Table E1. Preferably, the portion is a portion of any one of the nucleic acids given in Table E1, or is a portion of a nucleic acid encoding an orthologue or paralogue of any one of the amino acid sequences given in Table E1. Preferably the portion is, in increasing order of preference at least 300, 400, 500 or 600 consecutive nucleotides in length, the consecutive nucleotides being of any one of the nucleic acid sequences given in Table E1, or of a nucleic acid encoding an orthologue or paralogue of any one of the amino acid sequences given in Table E1. Most preferably the portion is a portion of the nucleic acid of SEQ ID NO: 321. Preferably, the portion encodes an amino acid sequence comprising (any one or more of the domains or motifs defined herein). Preferably, the portion encodes an amino acid sequence which when used in the construction of a phylogenetic tree, such as the one depicted in FIG. 20, tends to cluster with the group of SYPF1 polypeptides comprising the amino acid sequence represented by SEQ ID NO: 322 rather than with any other group.

Another nucleic acid variant useful in the methods of the invention is a nucleic acid capable of hybridising, under reduced stringency conditions, preferably under stringent conditions, with a nucleic acid encoding a SYPF1 polypeptide as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table E1, or comprising introducing and expressing in a plant a nucleic acid capable of hybridising to a nucleic acid encoding an orthologue, paralogue or homologue of any of the nucleic acid sequences given in Table E1.

Hybridising sequences useful in the methods of the invention encode a SYPF1 polypeptide as defined herein, and have substantially the same biological activity as the amino acid sequences given in Table E1. Preferably, the hybridising sequence is capable of hybridising to any one of the nucleic acids given in Table E1, or to a portion of any of these sequences, a portion being as defined above, or wherein the hybridising sequence is capable of hybridising to a nucleic acid encoding an orthologue or paralogue of any one of the amino acid sequences given in Table E1. Most preferably, the hybridising sequence is capable of hybridising to a nucleic acid as represented by SEQ ID NO: 321 or to a portion thereof. Preferably, the hybridising sequence encodes an amino acid sequence comprising any one or more of the motifs or domains as defined herein. Preferably, the hybridising sequence encodes an amino acid sequence which when used in the construction of a phylogenetic tree, such as the one depicted in FIG. 20, tends to cluster with the group of SYPF1 polypeptides comprising the amino acid sequence represented by SEQ ID NO: 322 rather than with any other group.

Another nucleic acid variant useful in the methods of the invention is a splice variant encoding a SYPF1 polypeptide as defined hereinabove, a splice variant being as defined herein.

According to the present invention, there is provided a method for enhancing yield-related traits in plants, comprising introducing and expressing in a plant a splice variant of any one of the nucleic acid sequences given in Table E1, or a splice variant of a nucleic acid encoding an orthologue, paralogue or homologue of any of the amino acid sequences given in Table E1.

Preferred splice variants are splice variants of a nucleic acid represented by SEQ ID NO: 321, or a splice variant of a nucleic acid encoding an orthologue or paralogue of SEQ ID NO: 322. Preferably, the amino acid sequence encoded by the splice variant comprises any one or more of the motifs or domains as defined herein. Preferably, the amino acid sequence encoded by the splice variant, when used in the construction of a phylogenetic tree, such as the one depicted in FIG. 20, tends to cluster with the group of SYPF1 polypeptides comprising the amino acid sequence represented by SEQ ID NO: 322 rather than with any other group.

Another nucleic acid variant useful in performing the methods of the invention is an allelic variant of a nucleic acid encoding a SYPF1 polypeptide as defined hereinabove, an allelic variant being as defined herein.

According to the present invention, there is provided a method for enhancing yield-related traits in plants, comprising introducing and expressing in a plant an allelic variant of any one of the nucleic acids given in Table E1, or comprising introducing and expressing in a plant an allelic variant of a nucleic acid encoding an orthologue, paralogue or homologue of any of the amino acid sequences given in Table E1.

The allelic variants useful in the methods of the present invention have substantially the same biological activity as the SYPF1 polypeptide of SEQ ID NO: 322 and any of the amino acids depicted in Table D1. Allelic variants exist in nature, and encompassed within the methods of the present invention is the use of these natural alleles. Preferably, the allelic variant is an allelic variant of SEQ ID NO: 321 or an allelic variant of a nucleic acid encoding an orthologue or paralogue of SEQ ID NO: 322. Preferably, the amino acid encoded by the allelic variant comprises any one or more of the motifs or domains as defined herein. Preferably, the amino acid sequence encoded by the allelic variant, when used in the construction of a phylogenetic tree, such as the one depicted in FIG. 20, tends to cluster with the group of SYPF1 polypeptides comprising the amino acid sequence represented by SEQ ID NO: 322 rather than with any other group.

Gene shuffling or directed evolution may also be used to generate variants of nucleic acids encoding SYPF1 polypeptides as defined above; the term "gene shuffling" being as defined herein.

According to the present invention, there is provided a method for enhancing yield-related traits in plants, comprising introducing and expressing in a plant a variant of any one of the nucleic acid sequences given in Table E1, or comprising introducing and expressing in a plant a variant of a nucleic acid encoding an orthologue, paralogue or homologue of any of the amino acid sequences given in Table E1, which variant nucleic acid is obtained by gene shuffling.

Preferably, the variant nucleic acid obtained by gene shuffling encodes an amino acid sequence comprising any one or more of the motifs or domains as defined herein. Preferably, the amino acid sequence encoded by the variant nucleic acid obtained by gene shuffling, when used in the construction of a phylogenetic tree such as the one depicted in FIG. 20, tends to cluster with the group of SYPF1 polypeptides comprising the amino acid sequence represented by SEQ ID NO: 322 rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding SYPF1 polypeptides may be derived from any natural or artificial source. The nucleic acid may be modified from its native form in composition and/or genomic environment through deliberate human manipulation. Preferably the SYPF1 polypeptide-encoding nucleic acid is from a plant, further preferably from a dicotyledonous plant, more preferably from the family Brassicaceae, more preferably from the genus *Arabidopsis*, most preferably from *Arabidopsis thaliana*.

Performance of the methods of the invention gives plants having enhanced yield-related traits. In particular, performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of suitable control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression, preferably increasing expression, in a plant of a nucleic acid encoding a SYPF1 polypeptide as defined herein.

Since the transgenic plants according to the present invention have increased yield, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression, preferably increasing expression, in a plant of a nucleic acid encoding a SYPF1 polypeptide as defined herein.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signaling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions increased yield relative to suitable control plants grown under comparable conditions. Therefore, according to the present invention, there is provided a method for increasing yield in plants grown under non-stress conditions or under mild drought conditions, which method comprises increasing expression in a plant of a nucleic acid encoding a SYPF1 polypeptide.

The present invention encompasses plants or parts thereof (including seeds) obtainable by the methods according to the present invention. The plants or parts thereof comprise a nucleic acid transgene encoding a SYPF1 polypeptide as defined above.

The invention also provides genetic constructs and vectors to facilitate introduction and/or expression in plants of nucleic acids encoding SYPF1 polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a SYPF1 polypeptide as defined above;
(b) one or more control sequences capable of driving expression of the nucleic acid sequence of (a); and optionally
(c) a transcription termination sequence.

The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter may be used to drive expression of the nucleic acid sequence. A constitutive promoter is particularly useful in the methods of the invention, particularly medium-strength constitutive promoters. It should be clear that the applicability of the present invention is not restricted to the SYPF1 polypeptide-encoding nucleic acid represented by SEQ ID NO: 321, nor is the applicability of the invention restricted to expression of a SYPF1 polypeptide-encoding nucleic acid when driven by a constitutive promoter.

The constitutive promoter is preferably an HMG (High Mobility Group) promoter. See the "Definitions" section herein for further examples of constitutive promoters.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1,000 transcripts per cell.

Optionally, one or more terminator sequences may be used in the construct introduced into a plant. Additional regulatory elements may include transcriptional as well as translational enhancers. Those skilled in the art will be aware of terminator and enhancer sequences that may be suitable for use in performing the invention. Such sequences would be known or may readily be obtained by a person skilled in the art.

An intron sequence may also be added to the 5' untranslated region (UTR) or in the coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg, Mol. Cell Biol. 8:4395-4405 (1988); Callis et al., Genes Dev. 1:1183-1200 (1987)). Such intron enhancement of gene expression is typically greatest when placed near the 5' end of the transcription unit. Use of the maize introns Adh1-S intron 1, 2, and 6, the Bronze-1 intron are known in the art. For general information, see The Maize Handbook, Chapter 116, Freeling and Walbot, Eds., Springer, N.Y. (1994).

Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

The invention also provides a method for the production of transgenic plants having enhanced yield-related traits relative to control plants, comprising introduction and expression in a plant of any nucleic acid encoding a SYPF1 polypeptide as defined hereinabove.

More specifically, the present invention provides a method for the production of transgenic plants having increased yield, which method comprises:
  (i) introducing and expressing in a plant or plant cell a SYPF1 polypeptide-encoding nucleic acid; and
  (ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a SYPF1 polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, sorghum and oats.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

As mentioned above, a preferred method for modulating (preferably, increasing) expression of a nucleic acid encoding a SYPF1 polypeptide is by introducing and expressing in a plant a nucleic acid encoding a SYPF1 polypeptide; however the effects of performing the method, i.e. enhancing yield-related traits may also be achieved using other well known techniques. A description of some of these techniques will now follow.

One such technique is T-DNA activation tagging (Hayashi et al. Science (1992) 1350-1353), which involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

The effects of the invention may also be reproduced using the technique of TILLING (Targeted Induced Local Lesions In Genomes); for a description of the same see the "definitions" section.

The effects of the invention may also be reproduced using homologous recombination; for a description of the same see the "definitions" section.

The present invention also encompasses use of nucleic acids encoding SYPF1 polypeptides as described herein and use of these SYPF1 polypeptide in enhancing any of the aforementioned yield-related traits in plants.

Nucleic acids encoding SYPF1 polypeptide described herein, or the SYPF1 polypeptides themselves, may find use in breeding programmes in which a DNA marker is identified which may be genetically linked to a SYPF1 polypeptide-encoding gene. The nucleic acids/genes, or the SYPF1 polypeptides themselves may be used to define a molecular marker. This DNA or protein marker may then be used in breeding programmes to select plants having enhanced yield-related traits as defined hereinabove in the methods of the invention.

Allelic variants of a SYPF1 polypeptide-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding SYPF1 polypeptides may also be used as probes for genetically and physically mapping the genes that they are a part of, and as markers for traits linked to those genes. Such information may be useful in plant breeding in order to develop lines with desired phenotypes. Such use of SYPF1 polypeptide-encoding nucleic acids requires only a nucleic acid sequence of at least 15 nucleotides in length. The SYPF1 polypeptide-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the SYPF1-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the SYPF1 polypeptide-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997)

Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

(v) RCA

Surprisingly, it has now been found that increasing expression in a plant of a nucleic acid sequence encoding a Ribulose-1,5-bisphosphate carboxylase/oxygenase (RuBisCO) activase (RCA) polypeptide gives plants having enhanced yield-related traits relative to control plants. The particular class of RCA polypeptides suitable for enhancing yield-related traits in plants is described in detail below.

The present invention provides a method for enhancing yield-related traits in plants relative to control plants, comprising increasing expression in a plant of a nucleic acid sequence encoding an RCA polypeptide.

Any reference hereinafter to a "polypeptide useful in the methods of the invention" is taken to mean an RCA polypeptide as defined herein. Any reference hereinafter to a "nucleic acid sequence useful in the methods of the invention" is taken to mean a nucleic acid sequence capable of encoding such an RCA polypeptide. The terms "polypeptide" and "protein" are as defined herein. The terms "polynucleotide(s)", "nucleic acid sequence(s)", "nucleotide sequence(s)" are also defined herein. The term "control plant" is also as defined herein.

A preferred method for increasing expression of a nucleic acid sequence encoding a polypeptide useful in the methods of the invention is by introducing and expressing in a plant a nucleic acid sequence encoding a polypeptide useful in the methods of the invention as defined below.

The nucleic acid sequence to be introduced into a plant (and therefore useful in performing the methods of the invention) is any nucleic acid sequence encoding the type of polypeptide which will now be described, hereafter also named "RCA nucleic acid sequence" or "RCA gene". An "RCA" polypeptide as defined herein refers to any polypeptide sequence that is not redox-regulated and comprising from N-terminus to C-terminus: (i) a plastidic transit peptide; (ii) in increasing order of preference at least 60%, 65%, 70%, 75%, 80%, 85%, 90%, 95% or 98% sequence identity to the AAA domain as represented by SEQ ID NO: 311.

Additionally, an RCA polypeptide may comprise within the AAA domain a Motif 1 G(G/R)KG(Q/E)GK(S/T) as represented by SEQ ID NO: 312. Within this motif, is allowed one or more conservative change at any position, and/or one or two non-conservative change(s) at any position.

Alternatively, an "RCA" polypeptide as defined herein refers to any polypeptide sequence that is not redox-regulated with in increasing order of preference at least 50%, 55%, 60%, 65%, 70%, 75%, 80%, 85%, 90%, 95% or 98% sequence identity to the RCA polypeptide as represented by SEQ ID NO: 251.

An RCA polypeptide that is not redox-regulated is herein taken to mean an RCA polypeptide that is not regulated by light via the ferredoxin/thioredoxin system. Examples of such RCA polypeptides are the naturally occurring beta (short form, or SF) RCA polypeptides, or alpha (long form, or LF)) RCA polypeptides that have been truncated or mutated in the C-terminal extension to prevent redox regulation.

Examples of polypeptides useful in the methods of the invention and nucleic acid sequences encoding the same are as given below in table D1 of the Examples section. Such RCA polypeptides are the naturally occurring beta (short form, or SF) RCA polypeptides, or alpha (long form, or LF)) RCA polypeptides that are truncated or mutated in the C-terminal extension to prevent redox regulation.

Also useful in the methods of the invention are homologues of any one of the polypeptide sequences given in table D1 in the Examples section. "Homologues" are defined in the Definitions section herein.

Also useful in the methods of the invention are derivatives of any one of the polypeptides given in table D1 or orthologues or paralogues of any of the aforementioned SEQ ID NOs. "Derivatives" are as defined in the Definitions section herein. Derivatives of SEQ ID NO: 251 or of any of the polypeptides given in table D1 are preferred.

The invention is illustrated by transforming plants with the *Chlamydomonas reinhardtii* nucleic acid sequence represented by SEQ ID NO: 250, encoding the polypeptide sequence of SEQ ID NO: 251, however performance of the invention is not restricted to these sequences. The methods of the invention may advantageously be performed using any nucleic acid sequence encoding a polypeptide useful in the methods of the invention as defined herein, including orthologues and paralogues, such as any of the nucleic acid sequences given in table D1. Such RCA polypeptides are the naturally occurring beta (short form, or SF) RCA polypeptides, or alpha (long form, or LF)) RCA polypeptides that are truncated or mutated in the C-terminal extension to prevent redox regulation.

The polypeptide sequences given in table D1 may be considered to be orthologues and paralogues of the RCA polypeptide represented by SEQ ID NO: 251, the terms "orthologues" and "paralogues" being as defined herein.

Orthologues and paralogues may easily be found by performing a so-called reciprocal blast search. Typically, this involves a first BLAST involving BLASTing a query sequence (for example using any of the sequences listed in table D1) against any sequence database, such as the publicly available NCBI database. BLASTN or TBLASTX (using standard default values) are generally used when starting from a nucleotide sequence, and BLASTP or TBLASTN (using standard default values) when starting from a polypeptide sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 250 or SEQ ID NO: 251, the second BLAST would therefore be against *Chlamydomonas reinhardtii* sequences). The results of the first and second BLASTs are then compared. A paralogue is identified if a high-ranking hit from the first blast is from the same species as from which the query sequence is derived, a BLAST back then ideally results in the query sequence as highest hit; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Table D1 gives examples of orthologues and paralogues of the RCA polypeptide represented by SEQ ID NO 251. Further orthologues and paralogues may readily be identified using the BLAST procedure described above. Such RCA polypeptides are the naturally occurring beta (short form, or SF) RCA polypeptides, or alpha (long form, or LF)) RCA polypeptides that are truncated or mutated in the C-terminal extension to prevent redox regulation.

The polypeptides of the invention are identifiable by the presence of the conserved AAA domain (shown in FIG. 14), the term "domain" being as defined herein. The term "motif", "consensus sequence" and "signature" are also defined herein.

The term "extension" as defined herein, refers to the additional amino acid residues of polypeptides extending beyond the last amino acid of the shortest polypeptide in a multiple sequence alignment. The amino acid residues may be naturally occurring, or modified by human intervention.

Specialist databases also exist for the identification of domains, for example, SMART (Schultz et al. (1998) Proc. Natl. Acad. Sci. USA 95, 5857-5864; Letunic et al. (2002) Nucleic Acids Res 30, 242-244, InterPro (Mulder et al., (2003) Nucl. Acids. Res. 31, 315-318, Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), or Pfam (Bateman et al., Nucleic Acids Research 30(1): 276-280 (2002). A set of tools for in silico analysis of polypeptide sequences is available on the ExPASY proteomics server (hosted by the Swiss Institute of Bioinformatics (Gasteiger et al., ExPASy: the proteomics server for in-depth protein knowledge and analysis, Nucleic Acids Res. 31:3784-3788 (2003)). For example, the AAA domain of SEQ ID NO: 251 is represented in the InterPro database by accession number IPR003959.

Domains may also be identified using routine techniques, such as by sequence alignment. Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains (such as the AAA domain, or Motif1 defined above) may be used as well. The sequence identity values, which are indicated below in Example 3 as a percentage were determined over the entire nucleic acid or polypeptide sequence, and/or over selected domains or conserved motif(s), using the programs mentioned above using the default parameters.

The task of protein subcellular localisation prediction is important and well studied. Knowing a protein's localisation helps elucidate its function. Experimental methods for protein localization range from immunolocalization to tagging of proteins using green fluorescent protein (GFP). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, Predotar, LipoP, MITOPROT, PATS, PTS1, SignalP and others. The identification of subcellular localisation of the polypeptide of the invention is described in the Examples section herein. In particular SEQ ID NO: 251 of the present invention is assigned to the plastidic (chloroplastic) compartment of photosynthetic (autotrophic) cells.

Methods for targeting to plastids are well known in the art and include the use of transit peptides. The table below shows examples of transit peptides which can be used to target any RCA polypeptide to a plastid, which RCA polypeptide is not, in its natural form, normally targeted to a plastid, or which RCA polypeptide in its natural form is targeted to a plastid by virtue of a different transit peptide (for example, its natural transit peptide). For example, a nucleic acid sequence encoding a cyanobacterial RCA polypeptide (from Anabaena, described by Li et al., (1993) Plant Molec Biol 21(5): 753-764; SEQ ID NO: 301) may also be suitable for use in the methods of the invention so long as the RCA polypeptide is targeted to a plastid, preferably to a chloroplast, and that it is not redox-regulated.

Examples of transit peptide sequences useful in targeting polypeptides to plastids

| NCBI Accession Number/SEQ ID NO | Source Organism | Protein Function | Transit Peptide Sequence |
|---|---|---|---|
| SEQ ID NO: P07839 | Chlamydomonas | Ferredoxin | MAMAMRSTFAARVGAKPAVRGARPASRMSCMA |

| NCBI Accession Number/SEQ ID NO | Source Organism | Protein Function | Transit Peptide Sequence |
|---|---|---|---|
| SEQ ID NO: AAR23425 | Chlamydomonas | Rubisco activase | MQVTMKSSAVSGQRVGGARVATRSVRRAQLQV |
| SEQ ID NO: CAA56932 | Arabidopsis thaliana | Aspartate amino transferase | MASLMLSLGSTSLLPREINKDKLKLGTSASNPFLK AKSFSRVTMTVAVKPSR |
| SEQ ID NO: CAA31991 | Arabidopsis thaliana | Acyl carrier protein1 | MATQFSASVSLQTSCLATTRISFQKPALISNHGKT NLSFNLRRSIPSRRLSVSC |
| SEQ ID NO: CAB63798 | Arabidopsis thaliana | Acyl carrier protein2 | MASIAASASISLQARPRQLAIAASQVKSFSNGRRS SLSFNLRQLPTRLTVSCAAKPETVDKVCAVVRKQ$$ |
| SEQ ID NO: CAB63799 | Arabidopsis thaliana | Acyl carrier protein3 | MASIATSASTSLQARPRQLVIGAKQVKSFSYGSRS NLSFNLRQLPTRLTVYCAAKPETVDKVCAVVRKQ LSLKE |

The RCA polypeptide is targeted and active in the chloroplast, i.e., the RCA polypeptide is capable of performing a dual activity: (re)-activation of RuBisCo, and ATP hydrolysis, in the chloroplast. Assays for testing these activities are well known in the art. Further details are provided in the Examples section herein.

Nucleic acid sequences encoding polypeptides useful in the methods of the invention need not be full-length nucleic acid sequences, since performance of the methods of the invention does not rely on the use of full-length nucleic acid sequences. Examples of nucleic acid sequences suitable for use in performing the methods of the invention include the nucleic acid sequences given in table D1, but are not limited to those sequences. Nucleic acid variants may also be useful in practising the methods of the invention. Examples of such nucleic acid variants include portions of nucleic acid sequences encoding a polypeptide useful in the methods of the invention, nucleic acid sequences hybridising to nucleic acid sequences encoding a polypeptide useful in the methods of the invention, splice variants of nucleic acid sequences encoding a polypeptide useful in the methods of the invention, allelic variants of nucleic acid sequences encoding a polypeptide useful in the methods of the invention and variants of nucleic acid sequences encoding a polypeptide useful in the methods of the invention that are obtained by site-directed mutagenesis. The terms portion, hybridising sequence, splice variant, allelic variant and site-directed mutagenesis will now be described.

According to the present invention, there is provided a method for enhancing yield-related traits in plants, comprising introducing and expressing in a plant a portion of any one of the nucleic acid sequences given in table D1, or a portion of a nucleic acid sequence encoding an orthologue, paralogue or homologue of any of the polypeptide sequences given in table D1. Such portions of RCA polypeptides are from naturally occurring beta (short form, or SF) RCA polypeptides, or from alpha (long form, or LF)) RCA polypeptides that are truncated or mutated in the C-terminal extension to prevent redox regulation.

Portions useful in the methods of the invention, encode a polypeptide falling within the definition of a nucleic acid sequence encoding a polypeptide useful in the methods of the invention as defined herein and having substantially the same biological activity as the polypeptide sequences given in table D1. Preferably, the portion is a portion of any one of the nucleic acid sequences given in table D1. The portion is typically at least 900 consecutive nucleotides in length, preferably at least 1000 consecutive nucleotides in length, more preferably at least 1100 consecutive nucleotides in length and most preferably at least 1227 consecutive nucleotides in length, the consecutive nucleotides being of any one of the nucleic acid sequences given in table D1. Preferably, the portion encodes a polypeptide sequence that is not redox-regulated and comprising from N-terminus to C-terminus: (i) a plastidic transit peptide; (ii) in increasing order of preference at least 60%, 65%, 70%, 75%, 80%, 85%, 90%, 95% or 98% sequence identity to the AAA domain as represented by SEQ ID NO: 311; and which may additionally comprise within the AAA domain a Motif 1 G(G/R)KG(Q/E)GK(S/T) as represented by SEQ ID NO: 312. Most preferably the portion is a portion of the nucleic acid sequence of SEQ ID NO: 250.

A portion of a nucleic acid sequence encoding an RCA polypeptide as defined herein may be prepared, for example, by making one or more deletions to the nucleic acid sequence. The portions may be used in isolated form or they may be fused to other coding (or non coding) sequences in order to, for example, produce a polypeptide that combines several activities, or to produce a polypeptide targeted to another subcellular compartment than its natural compartment. When fused to other coding sequences, the resultant polypeptide produced upon translation may be bigger than that predicted for the RCA polypeptide portion.

Another nucleic acid variant useful in the methods of the invention is a nucleic acid sequence capable of hybridising, under reduced stringency conditions, preferably under stringent conditions, with a nucleic acid sequence encoding an RCA polypeptide as defined herein, or with a portion as defined herein.

Hybridising sequences useful in the methods of the invention encode a polypeptide sequence comprising from N-terminus to C-terminus: (i) a plastidic transit peptide; (ii) in increasing order of preference at least 60%, 65%, 70%, 75%, 80%, 85%, 90%, 95% or 98% sequence identity to the AAA domain as represented by SEQ ID NO: 311; and which may additionally comprise within the AAA domain a Motif 1 G(G/R)KG(Q/E)GK(S/T) as represented by SEQ ID NO: 312. The hybridising sequence is typically at least 900 consecutive nucleotides in length, preferably at least 1000 consecutive nucleotides in length, more preferably at least 1100 consecutive nucleotides in length and most preferably at least 1200 consecutive nucleotides in length, the consecutive nucleotides being of any one of the nucleic acid sequences given in table D1. Preferably, the hybridising sequence is one that is capable of hybridising to any of the nucleic acid sequences given in table D1, or to a portion of any of these sequences, a portion being as defined above. Most preferably, the hybridising sequence is capable of hybridising to a nucleic acid sequence as represented by SEQ ID NO: 250 or to a portion thereof.

According to the present invention, there is provided a method for enhancing yield-related traits in plants, comprising introducing and expressing in a plant a nucleic acid sequence capable of hybridizing to any one of the nucleic acid sequences given in table D1, or comprising introducing and expressing in a plant a nucleic acid sequence capable of hybridising to a nucleic acid sequence encoding an orthologue, paralogue or homologue of any of the nucleic acid sequences given in the table D1. Such hybridising sequences encode naturally occurring beta (short form, or SF) RCA polypeptides, or encode alpha (long form, or LF)) RCA polypeptides that are truncated or mutated in the C-terminal extension to prevent redox regulation. The term "hybridisation" is as defined herein.

Another nucleic acid variant useful in the methods of the invention is a splice variant encoding an RCA polypeptide as defined hereinabove, the term "splice variant" being as defined herein.

According to the present invention, there is provided a method for enhancing yield-related traits in plants, comprising introducing and expressing in a plant a splice variant of any one of the nucleic acid sequences given in table D1, or a splice variant of a nucleic acid sequence encoding an orthologue, paralogue or homologue of any of the polypeptide sequences given in table D1. Such splice variants of nucleic acid sequences encode naturally occurring beta (short form, or SF) RCA polypeptides, or from alpha (long form, or LF)) RCA polypeptides that are truncated or mutated in the C-terminal extension to prevent redox regulation.

Preferred splice variants are splice variants of a nucleic acid sequence represented by SEQ ID NO: 250 or a splice variant of a nucleic acid sequence encoding an orthologue or paralogue of SEQ ID NO: 251. Preferably, the polypeptide sequence encoded by the splice variant comprises any one or more of the motifs or domains as defined herein.

Another nucleic acid variant useful in performing the methods of the invention is an allelic variant of a nucleic acid sequence encoding an RCA polypeptide as defined hereinabove. Alleles or allelic variants are alternative forms of a given gene, located at the same chromosomal position. Allelic variants exist in nature, and encompassed within the methods of the present invention is the use of these natural alleles. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

According to the present invention, there is provided a method for enhancing yield-related traits in plants, comprising introducing and expressing in a plant an allelic variant of any one of the nucleic acid sequences given in table D1, or comprising introducing and expressing in a plant an allelic variant of a nucleic acid sequence encoding an orthologue, paralogue or homologue of any of the polypeptide sequences given in table D1. Such allelic variants of nucleic acid sequences encode naturally occurring beta (short form, or SF) RCA polypeptides, or encode alpha (long form, or LF)) RCA polypeptides that are truncated or mutated in the C-terminal extension to prevent redox regulation.

Preferably, the allelic variant is an allelic variant of SEQ ID NO: 250 or an allelic variant of a nucleic acid sequence encoding an orthologue or paralogue of SEQ ID NO: 251. Preferably, the polypeptide sequence encoded by the allelic variant comprises any one or more of the motifs or domains as defined herein.

A further nucleic acid variant useful in the methods of the invention is a nucleic acid variant obtained by site-directed mutagenesis, which is defined in the Definitions section herein.

According to the present invention, there is provided a method for enhancing yield-related traits in plants, comprising introducing and expressing in a plant a variant of any one of the nucleic acid sequences given in table D1, or comprising introducing and expressing in a plant a variant of a nucleic acid sequence encoding an orthologue, paralogue or homologue of any of the polypeptide sequences given in table D1, which variant nucleic acid sequence is obtained by site-directed mutagenesis. Such nucleic acid variants obtained by site directed mutagenesis encode beta (short form, or SF) RCA polypeptides, or encode alpha (long form, or LF)) RCA polypeptides that are truncated or mutated in the C-terminal extension to prevent redox regulation.

Preferably, the variant nucleic acid sequence obtained by site-directed mutagenesis encodes a polypeptide sequence comprising any one or more of the motifs or domains as defined herein.

The following nucleic acid variants encoding RCA polypeptides are examples of variants suitable in practising the methods of the invention:
  (i) a portion of a nucleic acid sequence encoding an RCA polypeptide;
  (ii) a nucleic acid sequence capable of hybridising with a nucleic acid sequence encoding an RCA polypeptide;
  (iii) a splice variant of a nucleic acid sequence encoding an RCA polypeptide;
  (iv) an allelic variant of a nucleic acid sequence encoding an RCA polypeptide;
  (v) a nucleic acid sequence encoding an RCA polypeptide obtained by site-directed mutagenesis;
which RCA polypeptide is not redox-regulated.

Nucleic acid sequences encoding RCA polypeptides may be derived from any natural or artificial source. The nucleic acid sequence may be modified from its native form in composition and/or genomic environment through deliberate human manipulation. Preferably the nucleic acid sequence encoding an RCA polypeptide originates from a photosynthetic cell (Plantae kingdom). Further preferably the nucleic acid sequence encoding an RCA polypeptide originates from a plant cell. More preferably, the nucleic acid sequence encoding an RCA polypeptide originates from a diatom cell. Most preferably the nucleic acid sequence encoding an RCA polypeptide originates from an algal (red, brown or green) cell. The nucleic acid sequence may be isolated from green algae belonging Chlorophyta or Charophyta, or from land plants, non-vascular or vascular. Most preferably the nucleic acid sequence encoding an RCA polypeptide is from *Chlamydomonas reinhardtii*.

Any reference herein to an RCA polypeptide is therefore taken to mean an RCA polypeptide as defined above. Any nucleic acid sequence encoding such an RCA polypeptide is suitable for use in performing the methods of the invention.

The present invention also encompasses plants or parts thereof (including seeds) obtainable by the methods according to the present invention. The plants or parts thereof comprise a nucleic acid transgene encoding an RCA polypeptide as defined above.

The invention also provides genetic constructs and vectors to facilitate introduction and/or expression of the nucleic acid sequences useful in the methods according to the invention, in a plant. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising
(a) nucleic acid sequence encoding an RCA polypeptide, as defined above;
(b) one or more control sequences capable of driving expression of the nucleic acid sequence of (a); and optionally
(c) a transcription termination sequence.

A preferred construct is one in which the control sequence is a strong constitutive promoter, more preferably a GOS2 promoter, further preferably the rice GOS2 promoter, most preferably the rice GOS2 promoter as represented by SEQ ID NO: 306.

Alternatively, a preferred construct is one in which the control sequence is a constitutive promoter of medium strength, more preferably an HMGB promoter, further preferably the rice HMGB promoter as represented by SEQ ID NO: 307.

Alternatively, a preferred construct is one in which the control sequence is a green tissue-specific promoter, more preferably a protochlorophyllide reductase promoter, further preferably the rice protochlorophyllide reductase promoter as represented by SEQ ID NO: 308.

Plants are transformed with a vector comprising the sequence of interest (i.e., a nucleic acid sequence encoding an RCA polypeptide as defined herein. The skilled artisan is well aware of the genetic elements that must be present on the vector in order to successfully transform, select and propagate host cells containing the sequence of interest. The sequence of interest is operably linked to one or more control sequences (at least to a promoter). The terms "regulatory element", "control sequence" and "promoter" are as defined herein. The term "operably linked" is also as defined herein.

Advantageously, any type of promoter may be used to drive expression of the nucleic acid sequence. The term "promoter" refers to a nucleic acid control sequence located upstream from the transcriptional start of a gene and which is involved in recognising and binding of RNA polymerase and other proteins, thereby directing transcription of an operably linked nucleic acid sequence. A "plant" promoter comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

The promoter may be a constitutive promoter or an inducible promoter, for example a stress-inducible promoter. Alternatively, the promoter may be an organ-specific or tissue-specific promoter (see Definitions section herein for Definitions and examples of various promoter types).

In one embodiment, the nucleic acid sequence is operably linked to a strong constitutive promoter. Preferably the promoter is derived from a plant, more preferably the promoter is from a monocotyledonous plant if a monocotyledonous plant is to be transformed.

In a preferred embodiment, the constitutive promoter is a GOS2 promoter, further preferably a rice GOS2 promoter. Most preferably, the GOS2 promoter is as represented by SEQ ID NO: 306. It should be clear that the applicability of the present invention is not restricted to the nucleic acid sequence encoding an RCA polypeptide as represented by SEQ ID NO: 250, nor is the applicability of the invention restricted to expression of a nucleic acid sequence encoding an RCA polypeptide when driven by a GOS2 promoter.

Alternatively, the nucleic acid sequence is operably linked to a constitutive promoter, preferably an HMGB promoter, further preferably a rice HMGB promoter. Most preferably, the HMGB promoter is as represented by SEQ ID NO: 307. It should be clear that the applicability of the present invention is not restricted to the nucleic acid sequence encoding an RCA polypeptide as represented by SEQ ID NO: 250, nor is the applicability of the invention restricted to expression of a nucleic acid sequence encoding an RCA polypeptide when driven by an HMGB promoter.

According to another preferred embodiment, the nucleic acid encoding an RCA polypeptide is operably linked to a green tissue-specific promoter, preferably a protochlorophyllide reductase promoter, further preferably a rice protochlorophyllide reductase promoter. Most preferably, the green tissue-specific promoter is as represented by SEQ ID NO: 308. It should be clear that the applicability of the present invention is not restricted to the nucleic acid sequence encoding an RCA polypeptide as represented by SEQ ID NO: 250, nor is the applicability of the invention restricted to expression of a nucleic acid sequence encoding an RCA polypeptide when driven by a protochlorophyllide reductase promoter. Other green-tissue specific promoters which are available for the expression of genes in plants are described in DE-A 19644478.

For the identification of functionally equivalent promoters, the promoter strength and/or expression pattern of a candidate promoter may be analysed for example by operably linking the promoter to a reporter gene and assay the expression level and pattern of the reporter gene in various tissues of the plant. Suitable well-known reporter genes include for example beta-glucuronidase or beta galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid sequence used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500,0000 transcripts per cell. Conversely, a "strong promoter" drives expression of a coding sequence at high level, or at about 1/10 transcripts to about 1/100 transcripts to about 1/1,000 transcripts per cell.

Optionally, one or more terminator sequences may be used in the construct introduced into a plant; the term "terminator" being as defined herein. Additional regulatory elements may include transcriptional as well as translational enhancers. Those skilled in the art will be aware of terminator and enhancer sequences that may be suitable for use in performing the invention. Such sequences would be known or may readily be obtained by a person skilled in the art.

An intron sequence may also be added to the 5' untranslated region (UTR) or in the coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg, Mol. Cell Biol. 8:4395-4405 (1988); Callis et al., Genes Dev. 1:1183-1200 (1987)). Such intron enhancement of gene expression is typically greatest when placed near the 5' end of the transcription unit. Use of the maize introns Adh1-S intron 1, 2, and 6, the Bronze-1 intron are known in the art. For general information, see The Maize Handbook, Chapter 116, Freeling and Walbot, Eds., Springer, N.Y. (1994).

Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acid sequences, it is advantageous to use marker genes (or reporter genes). Therefore, the genetic construct may optionally comprise a selectable marker gene. As used herein, the term "selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luciferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acid sequences into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid sequence can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acid sequence have been introduced successfully, the process according to the invention for introducing the nucleic acid sequences advantageously employs techniques which enable the removal or excision of these marker genes. One such a method is what is known as co-transformation. The co-transformation method employs two vectors simultaneously for the transformation, one vector bearing the nucleic acid sequence according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid sequence (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the IoxP sequences. If the marker gene is integrated between the IoxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

The invention also provides a method for the production of transgenic plants having enhanced yield-related traits relative to control plants, comprising introduction and expression in a plant of any nucleic acid sequence encoding an RCA polypeptide as defined hereinabove. The terms "transgenic", "transgene" or "recombinant" are as defined herein.

More specifically, the present invention provides a method for the production of transgenic plants having enhanced yield-related traits relative to control plants, which method comprises:
(i) introducing and expressing in a plant or plant cell a nucleic acid sequence encoding an RCA polypeptide; and
(ii) cultivating the plant cell under conditions promoting plant growth and development.

The nucleic acid sequence may be introduced directly into a plant cell or into the plant itself (including introduction into a tissue, organ or any other part of a plant). According to a preferred feature of the present invention, the nucleic acid sequence is preferably introduced into a plant by transformation, the term "introduction" or "transformation" being as defined herein.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent, A F (1998). The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

The genetically modified plant cells can be regenerated via any methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid sequence encoding an RCA polypeptide as defined hereinabove. Preferred host cells according to the invention are plant cells.

Host plants for the nucleic acid sequences or the vector used in the method according to the invention, the expression cassette or construct or vector are, in principle, advantageously all plants, which are capable of synthesizing the polypeptides used in the inventive method.

A transgenic plant for the purposes of the invention is thus understood as meaning, as above, that the nucleic acid sequences used in the method of the invention are not at their natural locus in the genome of said plant, it being possible for the nucleic acid sequences to be expressed homologously or heterologously. However, as mentioned, transgenic also means that, while the nucleic acid sequences according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acid sequences according to the invention at an unnatural locus in the genome, i.e. homologous or, preferably, heterologous expression of the nucleic acid sequences takes place. Preferred transgenic plants are mentioned herein.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

Methods for increasing expression of nucleic acid sequences or genes, or gene products, are well documented in the art and include, for example, overexpression driven by appropriate promoters, the use of transcription enhancers or translation enhancers. Isolated nucleic acid sequences which serve as promoter or enhancer elements may be introduced in an appropriate position (typically upstream) of a non-heterologous form of a polynucleotide so as to upregulate expression. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention so as to control the expression of the gene.

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

The term "increasing expression" shall mean an increase of the expression of the nucleic acid sequence encoding an RCA polypeptide, which increase in expression leads to enhanced yield-related traits of the plants relative to control plants. Preferably, the increase in expression of the nucleic acid is 1.25, 1.5, 1.75, 2, 5, 7.5, 10, 15, 20, 25, 30, 35, 40, 45, 50, 55, 60, 65, 70, 75, 80, 85, 90, 95, 100 or more fold the expression of the endogenous plant RCA polypeptide.

By increasing the expression (in a plastid) of a nucleic acid sequence encoding an RCA polypeptide, an increase in the amount of RCA polypeptide is obtained. This increase in amount of RCA polypeptide (in a plastid) leads to an increase in RCA activity. Alternatively, activity may also be increased when there is no change in the amount of an RCA polypeptide, or even when there is a reduction in the amount of an RCA polypeptide. This may occur when the intrinsic properties of the polypeptide are altered, for example, by making mutant versions that are more active than the naturally-occurring polypeptide.

The expression of a nucleic acid sequence encoding an RCA polypeptide is increased in a plastid using techniques well known in the art, such as by targeting an RCA polypeptide to the plastid using transit peptide sequences or by direct transformation of an RCA polypeptide without transit peptide sequences, into a plastid. Expression may be increased in any plastid, however, preferred is preferentially increasing expression in a chloroplast.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added as described above.

Other control sequences (besides promoter, enhancer, silencer, intron sequences, 3'UTR and/or 5'UTR regions) may be protein and/or RNA stabilizing elements.

As mentioned above, a preferred method for increasing expression of a nucleic acid sequence encoding an RCA polypeptide is by introducing and expressing in a plant a nucleic acid sequence encoding an RCA polypeptide; however the effects of performing the method, i.e. enhancing yield-related traits may also be achieved using other well known techniques. A description of some of these techniques will now follow.

One such technique is T-DNA activation tagging (Hayashi et al. Science (1992) 1350-1353), which involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

The effects of the invention may also be reproduced using the technique of TILLING (Targeted Induced Local Lesions In Genomes). This is a mutagenesis technology useful to generate and/or identify a nucleic acid sequence encoding an RCA polypeptide with modified expression and/or activity. TILLING also allows selection of plants carrying such mutant variants. These mutant variants may exhibit modified expression, either in strength or in location or in timing (if the mutations affect the promoter for example). These mutant variants may exhibit higher RCA polypeptide activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

The effects of the invention may also be reproduced using homologous recombination, which allows introduction in a genome of a selected nucleic acid sequence at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J 9(10): 3077-84) but also for crop plants, for example rice (Terada et al. (2002) Nat Biotech 20(10): 1030-4; Iida and Terada (2004) Curr Opin Biotech 15(2): 132-8).

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants. The term "yield" and "seed yield" is as defined herein. The terms "increased", "improved", "enhanced" are as defined herein.

In particular, the enhanced yield-related trait is selected from one or more of the following: (i) increased early vigour; (ii) increased aboveground biomass; (iii) earlier time to flower; (iv) increased number of (filled) seeds; and (v) increased TKW.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

Enhanced yield-related traits may also result in modified architecture, or may occur because of modified architecture.

Since the transgenic plants according to the present invention have enhanced yield-related traits, it is likely that these plants exhibit an increased growth rate (during at least part of their life cycle), relative to the growth rate of control plants at a corresponding stage in their life cycle. The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced a dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soy bean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises increasing expression in a plant of a nucleic acid sequence encoding an RCA polypeptide as defined herein.

Enhanced yield-related traits and/or increased growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi and insects.

In particular, the methods of the present invention may be performed under non-stress conditions or under conditions of mild drought to give plants having enhanced yield-related traits relative to control plants. As reported in Wang et al. (Planta (2003) 218: 1-14), abiotic stress leads to a series of morphological, physiological, biochemical and molecular changes that adversely affect plant growth and productivity. Drought, salinity, extreme light conditions (low or high or of variable wavelength) extreme temperatures (high or low) and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signaling pathways and cellular responses, such as the production of stress proteins, up-regulation of antioxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Performance of the methods of the invention gives plants grown under non-stress conditions or under mild drought conditions enhanced yield-related traits relative to suitable control plants grown under comparable conditions. Therefore, according to the present invention, there is provided a method for enhancing yield-related traits in plants grown under non-stress conditions or under mild drought conditions, which method comprises increasing expression in a plant of a nucleic acid sequence encoding an RCA polypeptide.

In a preferred embodiment of the invention, the enhancement of yield-related traits and/or increase in growth rate occurs according to the methods of the present invention under non-stress conditions.

Performance of the methods according to the present invention results in plants grown under abiotic stress conditions having increased yield-related traits relative to control plants grown under comparable stress conditions. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of antioxidants, accumulation of compatible solutes and growth arrest. Since diverse environmental stresses activate similar pathways, the exemplification of the present invention with drought stress should not be seen as a limitation to drought stress, but more as a screen to indicate the involvement of RCA polypeptides as defined above, in increasing yield-related traits relative to control plants grown in comparable stress conditions, in abiotic stresses in general.

The term "abiotic stress" as defined herein is taken to mean any one or more of: water stress (due to drought or excess water), anaerobic stress, salt stress, temperature stress (due to hot, cold or freezing temperatures), chemical toxicity stress and oxidative stress. According to one aspect of the invention, the abiotic stress is an osmotic stress, selected from water stress, salt stress, oxidative stress and ionic stress. Preferably, the water stress is drought stress. The term salt stress is not restricted to common salt (NaCl), but may be any stress caused by one or more of: NaCl, KCl, LiCl, $MgCl_2$, $CaCl_2$, amongst others.

Performance of the methods of the invention gives plants having increased yield-related traits, under abiotic stress conditions relative to control plants grown in comparable stress conditions. Therefore, according to the present invention, there is provided a method for increasing yield-related traits, in plants grown under abiotic stress conditions, which method comprises increasing expression in a plant of a nucleic acid sequence encoding an RCA polypeptide. According to one aspect of the invention, the abiotic stress is an osmotic stress, selected from one or more of the following: water stress, salt stress, oxidative stress and ionic stress.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions.

Performance of the methods of the invention gives plants grown under conditions of reduced nutrient availability, particularly under conditions of reduced nitrogen availability, having increased yield-related traits relative to control plants grown under comparable conditions. Therefore, according to the present invention, there is provided a method for increasing yield-related traits in plants grown under conditions of reduced nutrient availability, preferably reduced nitrogen availability, which method comprises increasing expression in a plant of a nucleic acid sequence encoding an RCA polypeptide. Reduced nutrient availability may result from a deficiency or excess of nutrients such as nitrogen, phosphates and other phosphorous-containing compounds, potassium, calcium, cadmium, magnesium, manganese, iron and boron, amongst others. Preferably, reduced nutrient availability is reduced nitrogen availability.

The methods of the invention are advantageously applicable to any plant, the term "plant" being as defined herein.

According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, sorghum and oats.

The present invention also encompasses use of nucleic acid sequences encoding an RCA polypeptide described herein and use of these RCA polypeptides in enhancing yield-related traits in plants.

Nucleic acid sequences encoding an RCA polypeptide as described herein, or the RCA polypeptides themselves, may find use in breeding programmes in which a DNA marker is identified which may be genetically linked to a gene encoding an RCA polypeptide. The genes/nucleic acid sequences, or the RCA polypeptides themselves may be used to define a molecular marker. This DNA or polypeptide marker may then be used in breeding programmes to select plants having enhanced yield-related traits as defined hereinabove in the methods of the invention.

Allelic variants of a gene/nucleic acid sequence encoding an RCA polypeptide may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question, and which give enhanced yield-related traits. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acid sequences encoding an RCA polypeptide may also be used as probes for genetically and physically mapping the genes that they are a part of, and as markers for traits linked to those genes. Such information may be useful in plant breeding in order to develop lines with desired phenotypes. Such use of nucleic acid sequences encoding an RCA polypeptide requires only a nucleic acid sequence of at least 15 nucleotides in length. The nucleic acid sequences encoding an RCA polypeptide may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acid sequences encoding an RCA polypeptide. The resulting banding patterns may then be subjected to genetic analyses using computer programs such as MapMaker (Lander et al. (1987) Genomics 1: 174-181) in order to construct a genetic map. In addition, the nucleic acid sequences may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid sequence encoding an RCA polypeptide in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acid sequences. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

DESCRIPTION OF FIGURES

The present invention will now be described with reference to the following figures in which:

FIG. 1 shows the domain structure of the CCA1 protein represented by SEQ ID NO: 2. The SANT domain is given in bold underlined. Motifs 1 and 2 in the SANT domain are indicated in bold italics and underlined. Motifs 3, 4 and 5 are indicated in italics and underlined.

FIG. 4 details examples of CCA1 sequences useful in performing the methods according to the present invention.

FIG. 5A is a schematic representation in which (from left to right) the diagonally stripped box represents a signal peptide for insertion into the endomembrane system; the white box represents an N-terminal inhibitory domain; the dotted box represents an active domain; and the grey shaded box represents the carboxy inhibitory domain. The positions of the Hystidine-Cystein catalytic dyad is marked "H" and "C". FIG. 5B shows the position of the domains over a sequence alignment between a castor bean VPE (SEQ ID NO: 356) and SEQ ID NO: 150. The double line represents the signal peptide, the solid black line represents the active peptide; the black arrows indicate the putative aspartic residues at which autocatalytic processing occurs to produce the mature active peptide and the conserved Hys and Cys residues are boxed. Underlined with dots is the conserved active pentapeptide in caspases. The consensus sequence shown in FIG. 5B corresponds to SEQ ID NO: 359.

FIG. 6A shows a phylogenetic tree of polypeptides of the peptidase superfamily. VPE peptidases cluster apart of peptidases in clans CA, CF or CE. VPE polypeptides cluster in four subclases, alpha, beta, gamma and delta, with alpha and gamma being the closest related; FIG. 6B is an alignment of VPEs; the highest sequence conservation is found in the peptidase domain. The consensus sequence shown in FIG. 6B corresponds to SEQ ID NO: 360.

FIG. 8 shows VPE sequences useful in the methods of the invention.

FIG. 12 details examples of SAP sequences useful in performing the methods according to the present invention.

FIG. 17 details examples of RCA sequences useful in performing the methods according to the present invention.

FIG. 18 shows the sequence of SEQ ID NO: 322 with underlined F-rich (phenylalanine-rich) and C-rich (cysteine-rich) regions. Within the boxes are the four regions of so-called intrinsic disorder.

FIG. 19 shows a CLUSTAL W multiple sequence alignment of SYPF1 polypeptides from various species. Conserved regions, shown as Motifs IJI and III are boxed. The sequences shown are: arabidopsisABF19046.1" (SEQ ID NO: 346), ZW2"AT1G58330"NP 564730.1" (SEQ ID NO: 346), SPX) ID NO: 02 (SEQ ID NO: 357), AT4G18690"(SEQ ID NO: 343), At4g18690" (SEQ ID NO: 324), AT4G18680"NP 193603.1" (SEQ ID NO: 326), Nicotiana (SEQ ID NO: 340), Os01g0159000"NP 001042081.1" (SEQ ID NO: 336), AT4G18650(SEQ ID NO: 328), OBF4""CAA49524.1" (SEQ ID NO: 358), At5g10030"bZip (SEQ ID NO: 332), HBP-1b"="CAA40102.1"(SEQ ID NO: 334).

FIG. 22 details examples of SYPF1 sequences useful in performing the methods according to the present invention.

EXAMPLES

Figure 2:
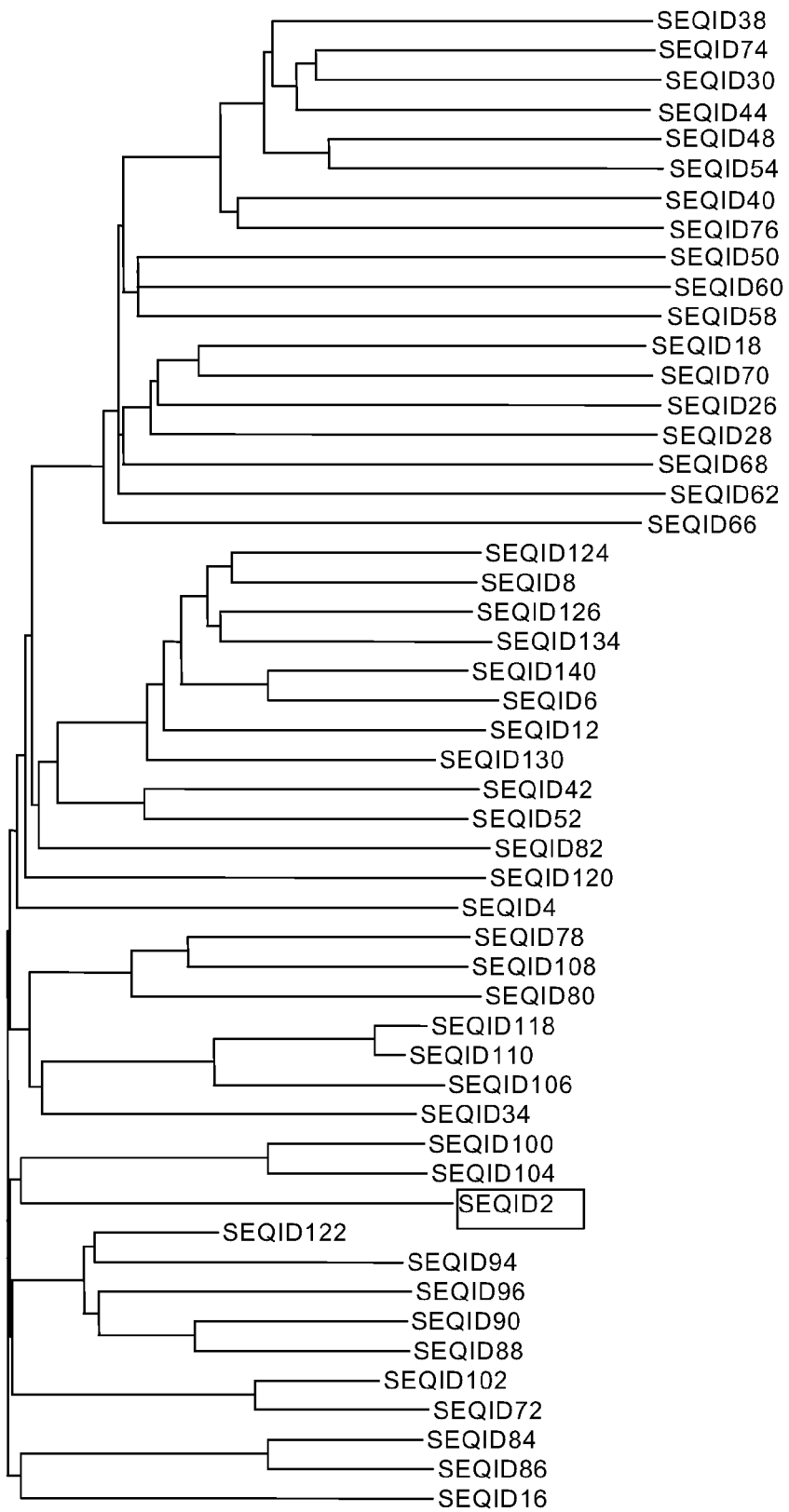
FIG. 2A shows a phylogenetic tree of CCA1 proteins.
FIG. 2B shows a multiple alignment of CCA1 proteins. The motifs indicated in FIG. 1 can easily be recognised, and new motifs may be defined using this alignment.

The present invention will now be described with reference to the following examples, which are by way of illustration alone. The following examples are not intended to completely define or to otherwise limit the scope of the invention.

Part I. CCA1

Example 1

Identification of Sequences Related to the CCA1 of SEQ ID NO: 1 and SEQ ID NO: 2

Sequences (full length cDNA, ESTs or genomic) related to SEQ ID NO: 1 and/or protein sequences related to SEQ ID NO: 2 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. The polypeptide encoded by SEQ ID NO: 1 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

Table A provides a list of nucleic acid and protein sequences related to the nucleic acid sequence as represented by SEQ ID NO: 1 and the protein sequence represented by SEQ ID NO: 2.

TABLE A

Nucleic acid sequences related to the nucleic acid sequence (SEQ ID NO: 1) useful in the methods of the present invention, and the corresponding deduced polypeptides.

| Name | Source organism | Nucleic acid SEQ ID NO: | Polypeptide SEQ ID NO: | Database accession number | Status |
|---|---|---|---|---|---|
| CCA1-like | Arabidopsis thaliana | 1 | 2 | / | Full length |
| MYB TF At1g01060 | Arabidopsis thaliana | 3 | 4 | AY519507 | Full length |
| Icl1 | Arabidopsis thaliana | 5 | 6 | AJ937209 | Full length |
| Icl2 | Arabidopsis thaliana | 7 | 8 | AJ937210 | Full length |
| Icl3 | Arabidopsis thaliana | 9 | 10 | AJ937211 | Full length |
| Icl4 | Arabidopsis thaliana | 11 | 12 | AJ937212 | Full length |
| Icl5 | Arabidopsis thaliana | 13 | 14 | AJ937213 | Full length |
| MYB TF At1g18330 | Arabidopsis thaliana | 15 | 16 | AY550299 | Full length |
| Myb-TF At1g19000 | Arabidopsis thaliana | 17 | 18 | AY079415 | Full length |
| MYB TF At1g70000 | Arabidopsis thaliana | 19 | 20 | AY519509 | Full length |
| MYB TF At1g74840 | Arabidopsis thaliana | 21 | 22 | AY519510 | Full length |
| MYB TF AT3G10113 | Arabidopsis thaliana | 23 | 24 | NM_148701 | Full length |
| MYB TF AT3G10580 | Arabidopsis thaliana | 25 | 26 | NM_111894 | Full length |
| MYB TF At3g10590 | Arabidopsis thaliana | 27 | 28 | AY550300 | Full length |
| MYB TF At3g16350 | Arabidopsis thaliana | 29 | 30 | AY519512 | Full length |
| MYB TF At4g09450 | Arabidopsis thaliana | 31 | 32 | AY122911 | Full length |
| MYB TF At5g37260 | Arabidopsis thaliana | 33 | 34 | AY519515 | Full length |
| MYB TF At5g47390 | Arabidopsis thaliana | 35 | 36 | AY519516 | Full length |
| MYB TF At5g56840 | Arabidopsis thaliana | 37 | 38 | AY519517 | Full length |
| MYB TF AT5G61620 | Arabidopsis thaliana | 39 | 40 | NM_125556 | Full length |
| MYB TF | Oryza sativa | 41 | 42 | LOC_Os01g06320 | Full length |
| MYB TF | Oryza sativa | 43 | 44 | LOC_Os01g09280 | Full length |
| MYB TF | Oryza sativa | 45 | 46 | LOC_Os01g09640 | Full length |
| MYB TF | Oryza sativa | 47 | 48 | LOC_Os01g41900 | Full length |
| MYB TF | Oryza sativa | 49 | 50 | LOC_Os02g30700 | Full length |
| MYB TF | Oryza sativa | 51 | 52 | LOC_Os05g07010 | Full length |
| MYB TF | Oryza sativa | 53 | 54 | LOC_Os05g10690 | Full length |
| MYB TF | Oryza sativa | 55 | 56 | LOC_Os05g51160 | Full length |
| MYB TF | Oryza sativa | 57 | 58 | LOC_Os06g07640 | Full length |
| MYB TF | Oryza sativa | 59 | 60 | LOC_Os06g07650 | Full length |
| MYB TF | Oryza sativa | 61 | 62 | LOC_Os06g07700 | Full length |
| MYB TF | Oryza sativa | 63 | 64 | LOC_Os06g07740 | Full length |
| MYB TF | Oryza sativa | 65 | 66 | LOC_Os06g45840 | Full length |
| MYB TF | Oryza sativa | 67 | 68 | LOC_Os08g04840 | Full length |
| MYB TF | Oryza sativa | 69 | 70 | LOC_Os08g05510 | Full length |
| MYB TF | Oryza sativa | 71 | 72 | LOC_Os08g06110 | Full length |
| MYB TF | Oryza sativa | 73 | 74 | LOC_Os10g41200 | Full length |
| MYB TF | Oryza sativa | 75 | 76 | LOC_Os10g41260 | Full length |
| MYB TF | Oryza sativa | 77 | 78 | LOC_Os02g46030 | Full length |
| MYB TF | Oryza sativa | 79 | 80 | LOC_Os04g49450 | Full length |
| MYB TF | Oryza sativa | 81 | 82 | LOC_Os06g51260 | Full length |
| LpLHY H1 | Lemna paucicostata | 83 | 84 | AB210845 | Full length |
| LgLHY H1 | Lemna gibba | 85 | 86 | AB210849 | Full length |
| MYB TF | Castanea sativa | 87 | 88 | AY611029 | Full length |
| MYB TF | Phaseolus vulgaris | 89 | 90 | AJ420902 | Full length |

TABLE A-continued

Nucleic acid sequences related to the nucleic acid sequence (SEQ ID NO: 1) useful
in the methods of the present invention, and the corresponding deduced polypeptides.

| Name | Source organism | Nucleic acid SEQ ID NO: | Polypeptide SEQ ID NO: | Database accession number | Status |
|---|---|---|---|---|---|
| MYB114 | Glycine max | 91 | 92 | DQ822977 | partial |
| CCA1-like | Mesembryanthemum crystallinum | 93 | 94 | AY371287 | Full length |
| MYB clone 114030R | Lycopersicon esculentum | 95 | 96 | BT012912 | Full length |
| MYB186 | Glycine max | 97 | 98 | DQ822982 | partial |
| LgLHY H2 | Lemna gibba | 99 | 100 | AB210850 | Full length |
| MYB PCO118792 | Zea mays | 101 | 102 | AY103618 | Full length |
| LpLHY H2 | Lemna paucicostata | 103 | 104 | AB210846 | Full length |
| MYB177 | Glycine max | 105 | 106 | DQ822925 | Full length |
| MYB clone wlm96.pk054.b21:fis | Triticum aestivum | 107 | 108 | BT009406 | Full length |
| MYB173 | Glycine max | 109 | 110 | DQ822922 | Full length |
| MYB140 | Glycine max | 111 | 112 | DQ822986 | partial |
| MYB131 | Glycine max | 113 | 114 | DQ822983 | partial |
| MYB144 | Glycine max | 115 | 116 | DQ822987 | partial |
| MYB174 | Glycine max | 117 | 118 | DQ822939 | partial |
| LHY-like | Ostreococcus tauri | 119 | 120 | AY740076 | partial |
| MYB, clone mth2-71o19 | Medicago truncatula | 121 | 122 | AC150443 | partial |
| MYBR5 | Malus x domestica | 123 | 124 | DQ074476 | Full length |
| MYB, clone wdk1c.pk011.f12:fis, | Triticum aestivum | 125 | 126 | BT008954 | Full length |
| MYB148 | Glycine max | 127 | 128 | DQ822956 | partial |
| MYB135 | Glycine max | 129 | 130 | DQ822955 | partial |
| Myb2 | Pisum sativum | 131 | 132 | AY826731 | partial |
| MYB133 | Glycine max | 133 | 134 | DQ822916 | Full length |
| MYB146 | Glycine max | 135 | 136 | DQ822984 | partial |
| MYB155 | Glycine max | 137 | 138 | DQ822940 | partial |
| MYB118 | Glycine max | 139 | 140 | DQ822912 | Full length |

Example 2

Alignment of Relevant Polypeptide Sequences

AlignX from the Vector NTI (Invitrogen) is based on the Clustal algorithm of progressive alignment (Thompson et al. (1997) Nucleic Acids Res 25:4876-4882; Chenna et al. (2003). Nucleic Acids Res 31:3497-3500). A phylogenetic tree can be constructed using a neighbour-joining clustering algorithm. Default values are for the gap open penalty of 10, for the gap extension penalty of 0.1 and the selected weight matrix is Blosum 62 (if polypeptides are aligned).

The result of the multiple sequence alignment using polypeptides relevant in identifying the ones useful in performing the methods of the invention is shown in FIG. 2. A selection of the sequences used for the multiple alignment was used as input data for calculating the phylogenetic tree. Although there is little overall sequence conservation (see example 3), regions of high conservation can be discriminated, such as the motifs of SEQ ID NO: 141 to 145, but additional motifs may be derived from the alignment.

Example 3

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table A1 for the global similarity and identity over the full length of the polypeptide sequences (excluding the partial polypeptide sequences). Percentage identity is given above the diagonal in bold and percentage similarity is given below the diagonal (normal face).

The percentage identity between the polypeptide sequences useful in performing the methods of the invention can be as low as 9% amino acid identity compared to SEQ ID NO: 2.

TABLE A1

MatGAT results for global similarity and identity over the full length of the polypeptide sequences.

| | 1 | 2 | 3 | 4 | 5 | 6 | 7 | 8 | 9 | 10 | 11 | 12 | 13 |
|---|---|---|---|---|---|---|---|---|---|---|---|---|---|
| 1. SEQID2 | | 42.4 | 17.2 | 16.3 | 16.9 | 17.4 | 18.8 | 21.6 | 12.5 | 11.9 | 11.3 | 19.4 | 13 |
| 2. SEQID4 | 57.8 | | 16.4 | 15.3 | 15.1 | 14.9 | 16.4 | 21.5 | 12.1 | 11 | 11.3 | 18.8 | 11.9 |
| 3. SEQID6 | 25.5 | 25.4 | | 44.2 | 47.4 | 43.8 | 69.8 | 25.3 | 17.5 | 14.4 | 14.3 | 25.9 | 21.3 |
| 4. SEQID8 | 25.7 | 24.5 | 57.6 | | 44.9 | 46.6 | 47.6 | 25.9 | 18.8 | 18.8 | 19.2 | 27.5 | 19.7 |
| 5. SEQID10 | 25 | 24.7 | 61.1 | 61.8 | | 58.8 | 47.5 | 27 | 17 | 18.6 | 19.1 | 26.3 | 19.2 |
| 6. SEQID12 | 25.5 | 24.5 | 57.6 | 60.9 | 73.2 | | 44.8 | 26.2 | 15.8 | 16.7 | 17.6 | 26.8 | 19.8 |
| 7. SEQID14 | 26.3 | 24.7 | 78.5 | 57 | 59.6 | 56.6 | | 26.9 | 15.2 | 16.6 | 14.6 | 26.5 | 20.6 |
| 8. SEQID16 | 32.6 | 31.3 | 41.6 | 42.5 | 42.5 | 44.8 | 43.1 | | 16.8 | 17 | 15.2 | 88.1 | 15.5 |
| 9. SEQID18 | 22.2 | 20.5 | 29.4 | 30.9 | 35.9 | 29.1 | 29.8 | 29.5 | | 39 | 55.9 | 16.1 | 25.9 |
| 10. SEQID20 | 19.4 | 18 | 29 | 30.9 | 36.2 | 32.5 | 31.2 | 27.7 | 51.2 | | 40.6 | 17.7 | 24.9 |
| 11. SEQID22 | 20.1 | 19.1 | 33.1 | 33.3 | 34.1 | 33.1 | 34.4 | 31.5 | 69.8 | 54 | | 15.2 | 28 |
| 12. SEQID24 | 30.8 | 28.7 | 43.5 | 44 | 41.7 | 42.6 | 42.6 | 92.2 | 29.8 | 30.7 | 31.8 | | 18.2 |
| 13. SEQID26 | 20.1 | 20.5 | 38.2 | 32.1 | 36.6 | 35.8 | 36.9 | 31.8 | 41.8 | 41.1 | 42.5 | 32.7 | |
| 14. SEQID28 | 16.4 | 17.8 | 29.7 | 27 | 30 | 27.8 | 33 | 23.7 | 35.8 | 37.2 | 37.4 | 23.5 | 40.4 |
| 15. SEQID30 | 25.2 | 22.2 | 30.5 | 35.1 | 27.6 | 29.7 | 26.6 | 29.2 | 44.7 | 42.1 | 42.1 | 30.2 | 32.8 |
| 16. SEQID32 | 15.6 | 16.3 | 29.4 | 24.8 | 26.5 | 27.8 | 28 | 27.5 | 37.5 | 33 | 38.1 | 28 | 54.7 |
| 17. SEQID34 | 28.5 | 28.4 | 46.1 | 42.4 | 46.7 | 43 | 46.3 | 51.7 | 30 | 30 | 28.9 | 49.1 | 29.3 |
| 18. SEQID36 | 23.2 | 23.6 | 33.7 | 34 | 33.2 | 35.3 | 34 | 38.4 | 43.6 | 45.2 | 41.6 | 33.2 | 32.6 |
| 19. SEQID38 | 18.8 | 17.1 | 27.3 | 30.3 | 27.5 | 34.1 | 35.1 | 27.7 | 44.2 | 47.9 | 48.3 | 26.8 | 36.2 |
| 20. SEQID40 | 23.2 | 21.4 | 30.9 | 35.8 | 32.5 | 37.2 | 29.3 | 28.9 | 43.8 | 45.7 | 44.5 | 36 | 39.4 |
| 21. SEQID42 | 28.9 | 25.7 | 52.3 | 50.9 | 52.6 | 52.6 | 51.3 | 41.3 | 28.8 | 30.1 | 28.4 | 40.5 | 28.4 |
| 22. SEQID44 | 22.5 | 23.3 | 33.3 | 30.6 | 31.1 | 32.5 | 32.2 | 33.6 | 42.9 | 44.3 | 41 | 32 | 34.7 |
| 23. SEQID46 | 20.9 | 20.9 | 35.5 | 37.3 | 39 | 36.5 | 30.6 | 30.3 | 46.5 | 46.8 | 47.1 | 30.7 | 36.8 |
| 24. SEQID48 | 20.9 | 19.5 | 24.6 | 27.3 | 25.6 | 23.8 | 27.9 | 27.7 | 42.5 | 49.2 | 43.5 | 26.5 | 37.2 |
| 25. SEQID50 | 20.2 | 20 | 28 | 28.5 | 31.4 | 29.1 | 34 | 30.9 | 38.6 | 31.9 | 29.7 | 29.8 | 38.3 |
| 26. SEQID52 | 22.9 | 22 | 45.4 | 41.2 | 42.5 | 46 | 46.1 | 38.2 | 29.8 | 29.5 | 29.4 | 37.2 | 34.1 |
| 27. SEQID54 | 20.2 | 19.1 | 30 | 29.7 | 30.3 | 29.8 | 31.4 | 30.9 | 47.4 | 53 | 51.2 | 29.5 | 40.8 |
| 28. SEQID56 | 21.4 | 18.4 | 27 | 28.8 | 30.3 | 28.5 | 28.7 | 26 | 45.3 | 48.5 | 48.5 | 28.9 | 37.3 |
| 29. SEQID58 | 21.9 | 20.5 | 26.5 | 28.5 | 30.2 | 26.2 | 25.5 | 25.7 | 38 | 38.9 | 37.4 | 31.3 | 35.5 |
| 30. SEQID60 | 24.3 | 22.5 | 27.7 | 27.9 | 25.6 | 29.7 | 25.6 | 30.7 | 32.7 | 29.4 | 33.5 | 31.7 | 32.7 |
| 31. SEQID62 | 20.7 | 20.8 | 29.5 | 30 | 26.5 | 27.2 | 25.8 | 30.1 | 36.2 | 32.6 | 35.6 | 30.1 | 36.9 |
| 32. SEQID64 | 22.7 | 21.4 | 29.6 | 29.6 | 28.5 | 28.5 | 29.8 | 33.4 | 29.3 | 28.5 | 32.3 | 30.9 | 32.9 |
| 33. SEQID66 | 13.7 | 14 | 30.4 | 29.1 | 31.4 | 33.8 | 31.6 | 22 | 21.8 | 20.7 | 28.3 | 23.5 | 22.6 |
| 34. SEQID68 | 24.2 | 24 | 30.3 | 32.1 | 29.2 | 31.9 | 32.1 | 31.3 | 38.4 | 39.7 | 36 | 32.4 | 32.6 |
| 35. SEQID70 | 25.2 | 23.4 | 33.6 | 37.2 | 32.7 | 37.5 | 33 | 34.1 | 42.2 | 37.8 | 41.9 | 35.4 | 34.5 |
| 36. SEQID72 | 52.3 | 54.2 | 22.5 | 24.2 | 21.1 | 23.1 | 23.5 | 27.1 | 18.2 | 17.9 | 17.2 | 25.9 | 18.5 |
| 37. SEQID74 | 21.2 | 21.4 | 40.6 | 36.7 | 30.8 | 38.7 | 38.1 | 33.8 | 48.6 | 46.5 | 48.1 | 37.8 | 34 |
| 38. SEQID76 | 21.7 | 18.1 | 37.5 | 34.2 | 38.3 | 36.1 | 37.2 | 28 | 43.9 | 45.7 | 47.5 | 33.6 | 41.5 |
| 39. SEQID78 | 36.8 | 34.4 | 30.8 | 32 | 31.8 | 33 | 31 | 40.1 | 24.4 | 23 | 22.6 | 38.3 | 22.2 |
| 40. SEQID80 | 39.6 | 36.3 | 32.8 | 34.3 | 29.6 | 31.7 | 32.2 | 41.5 | 25.7 | 24.6 | 21.8 | 40 | 24.2 |
| 41. SEQID82 | 37.5 | 34.4 | 35.3 | 37.3 | 34.4 | 35.7 | 35 | 43.9 | 27.7 | 26.6 | 24.8 | 42.6 | 29.5 |
| 42. SEQID84 | 52.6 | 50.1 | 28.7 | 29.4 | 27.3 | 28.3 | 27.2 | 35.2 | 21.2 | 21.3 | 22.1 | 33 | 24.2 |
| 43. SEQID86 | 52 | 53.3 | 27.4 | 26.7 | 25.6 | 27.2 | 27.2 | 33.9 | 20.5 | 20 | 20.1 | 30.6 | 20.1 |
| 44. SEQID88 | 54 | 58.9 | 22.3 | 22.1 | 19.5 | 20.2 | 20.2 | 25.3 | 16.8 | 17.4 | 18.5 | 25.4 | 18.4 |
| 45. SEQID90 | 53.1 | 61 | 23.4 | 22.7 | 21.3 | 22.4 | 21.3 | 27.7 | 18.4 | 16.9 | 16.2 | 26.4 | 18.7 |
| 46. SEQID94 | 52.4 | 58.1 | 22.6 | 23.3 | 20.4 | 22.1 | 20.3 | 27.2 | 18.1 | 18.4 | 16.9 | 25.4 | 16.6 |
| 47. SEQID96 | 50.7 | 55.1 | 21.8 | 22.7 | 21.3 | 22.4 | 20.7 | 26 | 19.2 | 16.7 | 17.3 | 24.9 | 16.9 |
| 48. SEQID100 | 50 | 47.9 | 33.6 | 34.9 | 32.4 | 31.3 | 32.9 | 40.5 | 26.6 | 25 | 24.1 | 38.3 | 27 |
| 49. SEQID102 | 30.3 | 30.4 | 44.7 | 44.8 | 46.3 | 41.4 | 48.6 | 43.3 | 29.8 | 36.1 | 31.8 | 42.6 | 30.3 |
| 50. SEQID104 | 48.5 | 47.1 | 31.4 | 31.6 | 31.8 | 33.6 | 34.3 | 41.3 | 26 | 23.9 | 21.7 | 39.3 | 25.5 |
| 51. SEQID106 | 35.7 | 33.6 | 36.5 | 38.5 | 35.1 | 36.2 | 33.7 | 46.6 | 26.4 | 24.1 | 24.1 | 45.2 | 27.5 |
| 52. SEQID108 | 36.5 | 35.7 | 32.3 | 34.7 | 31.2 | 32.7 | 34.1 | 43.4 | 25.4 | 26.9 | 26.3 | 42.3 | 25.2 |
| 53. SEQID110 | 28.3 | 25.4 | 44.7 | 42.7 | 44.9 | 42.1 | 46 | 49.4 | 38.3 | 37.3 | 32.1 | 47.3 | 39 |
| 54. SEQID124 | 27.6 | 25.6 | 61.6 | 72.7 | 60.7 | 61.9 | 58.5 | 47.4 | 30.3 | 28.5 | 32.8 | 46.1 | 33.4 |
| 55. SEQID126 | 26.8 | 25.1 | 64.5 | 62.1 | 66.2 | 63.9 | 65.7 | 43.4 | 32.2 | 32.5 | 31.8 | 42.3 | 31.4 |
| 56. SEQID134 | 27.1 | 28.2 | 55.9 | 68.6 | 63.1 | 63.7 | 59.8 | 46.2 | 32 | 27.2 | 34.7 | 45.2 | 33.5 |
| 57. SEQID140 | 24.8 | 23.3 | 70.6 | 55.2 | 58.2 | 57 | 78 | 40.8 | 34 | 29.3 | 37.6 | 40.8 | 39 |

| | 14 | 15 | 16 | 17 | 18 | 19 | 20 | 21 | 22 | 23 | 24 | 25 | 26 |
|---|---|---|---|---|---|---|---|---|---|---|---|---|---|
| 1. SEQID2 | 10 | 14.1 | 9 | 20.2 | 12.2 | 12.5 | 12.5 | 19.9 | 13.3 | 13.7 | 13.5 | 12 | 16.6 |
| 2. SEQID4 | 9.9 | 11.7 | 10.5 | 21 | 13.3 | 10.5 | 13 | 18.1 | 12.7 | 12.4 | 10.2 | 11.9 | 14.9 |
| 3. SEQID6 | 14.7 | 16.5 | 15 | 27.1 | 19.8 | 14 | 16.7 | 35.3 | 18.3 | 16.2 | 11.6 | 17.5 | 29 |
| 4. SEQID8 | 15.1 | 22 | 15.4 | 25.5 | 20 | 19.1 | 17.2 | 34.3 | 18.9 | 20.5 | 13.3 | 15 | 28.1 |
| 5. SEQID10 | 15.3 | 17.2 | 12.9 | 28.9 | 18.9 | 14.6 | 18.3 | 32.6 | 20.1 | 18.8 | 13.5 | 14.7 | 27.9 |
| 6. SEQID12 | 13.7 | 17 | 13.5 | 27.3 | 19 | 17.9 | 19 | 34.6 | 19.3 | 18.6 | 11.4 | 14.5 | 29 |
| 7. SEQID14 | 18.5 | 17.6 | 14.1 | 29.2 | 19.7 | 19.9 | 15.9 | 34.4 | 19.3 | 15.8 | 13.3 | 14.9 | 31.4 |
| 8. SEQID16 | 12.7 | 14.2 | 14.4 | 35.1 | 18.7 | 17.7 | 15.3 | 22.7 | 16 | 14.8 | 13.9 | 15.9 | 23.4 |
| 9. SEQID18 | 23.6 | 30.8 | 26 | 12.7 | 33.3 | 30.9 | 29.5 | 14.1 | 31.7 | 31.1 | 26.8 | 19.3 | 19.1 |
| 10. SEQID20 | 23 | 34.2 | 23 | 15.9 | 32.6 | 36.1 | 31.1 | 14 | 32.2 | 34.1 | 34.5 | 16.4 | 16.5 |
| 11. SEQID22 | 20.7 | 28.9 | 28 | 13.4 | 31.6 | 30.4 | 27.6 | 14.1 | 29.9 | 30 | 28.4 | 13.9 | 12.4 |
| 12. SEQID24 | 13.6 | 14.4 | 13.4 | 33.3 | 18.9 | 16.8 | 17.4 | 22.2 | 15.7 | 14.3 | 13.6 | 14.7 | 23.1 |
| 13. SEQID26 | 28.4 | 20.7 | 48.8 | 12 | 19.9 | 23.9 | 25.9 | 14.8 | 23.5 | 23.7 | 23.6 | 20.5 | 18.8 |
| 14. SEQID28 | | 14.5 | 38 | 17.4 | 16.2 | 24.8 | 17.1 | 15.9 | 15.1 | 22 | 22.1 | 20.7 | 16 |
| 15. SEQID30 | 24.5 | | 19.1 | 13.1 | 41.4 | 27.6 | 29.1 | 16.7 | 46.6 | 33.8 | 35.8 | 15.9 | 15.4 |

TABLE A1-continued

MatGAT results for global similarity and identity over the full length of the polypeptide sequences.

| | | | | | | | | | | | | | | |
|---|---|---|---|---|---|---|---|---|---|---|---|---|---|---|
| 16. SEQID32 | 56.8 | 27.9 | | 15.2 | 19 | 23.3 | 21.8 | 12.3 | 19.3 | 22.3 | 23.5 | 23.2 | 14.1 |
| 17. SEQID34 | 33.4 | 26.6 | 25.8 | | 17.3 | 15.3 | 14.8 | 26.7 | 15.6 | 16.3 | 12.4 | 16.2 | 26 |
| 18. SEQID36 | 26 | 57.4 | 27.1 | 31.8 | | 29.3 | 32 | 19.2 | 44.4 | 32 | 28.6 | 13.2 | 15.1 |
| 19. SEQID38 | 39.9 | 37.7 | 32.6 | 29.3 | 37.5 | | 32.6 | 11.4 | 29.6 | 38.9 | 37 | 19 | 12.6 |
| 20. SEQID40 | 29.7 | 42.9 | 31.2 | 26.8 | 46 | 44.8 | | 15.7 | 32.7 | 32.1 | 26.4 | 13 | 16.1 |
| 21. SEQID42 | 28.4 | 28.9 | 24.5 | 44.4 | 33.7 | 28.1 | 31.2 | | 17.3 | 16.2 | 12.5 | 15.6 | 39.9 |
| 22. SEQID44 | 24.9 | 59.7 | 24.9 | 27.9 | 60.1 | 41.3 | 47 | 31.7 | | 31.1 | 32.4 | 15.2 | 16.9 |
| 23. SEQID46 | 32.9 | 49.9 | 31.3 | 29 | 47.7 | 50 | 47.3 | 32.6 | 47.5 | | 46.3 | 19.1 | 17.5 |
| 24. SEQID48 | 32.6 | 45.7 | 30.9 | 30.2 | 45.5 | 49.8 | 46.1 | 23.2 | 47.3 | 58.7 | | 17.8 | 14.4 |
| 25. SEQID50 | 33 | 26.4 | 34.4 | 32.1 | 24.9 | 35.9 | 24.3 | 30.1 | 24.6 | 37.4 | 33.9 | | 18.4 |
| 26. SEQID52 | 31.7 | 24.3 | 25.6 | 42.2 | 26.8 | 26.8 | 27.4 | 52.3 | 27 | 30 | 26.2 | 30.1 | |
| 27. SEQID54 | 34.5 | 44.7 | 35.5 | 30.7 | 43.3 | 49.8 | 46.7 | 30.4 | 42.3 | 72.3 | 58.8 | 35.5 | 25.8 |
| 28. SEQID56 | 36.3 | 44.2 | 35.9 | 31.7 | 40.8 | 48.5 | 45.1 | 24.5 | 41.5 | 54.2 | 64.5 | 39.5 | 28.9 |
| 29. SEQID58 | 32.1 | 35.1 | 32.1 | 29.3 | 25.5 | 33 | 42.7 | 24.9 | 29 | 41.1 | 38.9 | 34 | 24.6 |
| 30. SEQID60 | 26.6 | 34.8 | 27.4 | 29.7 | 35 | 28.2 | 29.9 | 27.4 | 36.8 | 31.2 | 34.3 | 27.4 | 26.1 |
| 31. SEQID62 | 26.5 | 31 | 31.2 | 28.9 | 34.8 | 34.9 | 36.3 | 29.1 | 29.5 | 38.4 | 37.9 | 32.6 | 26.8 |
| 32. SEQID64 | 24.6 | 32.3 | 26.5 | 28.2 | 29.3 | 29.3 | 35.6 | 26.5 | 32 | 35.4 | 31.8 | 27.9 | 24 |
| 33. SEQID66 | 26.2 | 19.6 | 27.5 | 24 | 20 | 33 | 22.1 | 29.4 | 20.8 | 19.4 | 23.9 | 23.6 | 25.2 |
| 34. SEQID68 | 23.5 | 50.1 | 23.2 | 29.2 | 53.3 | 35 | 47 | 31.9 | 50.4 | 43.1 | 39.9 | 25.1 | 26.4 |
| 35. SEQID70 | 27.1 | 41.1 | 27.7 | 33 | 43.8 | 43.4 | 44.5 | 36.9 | 43.7 | 50.1 | 41.3 | 26.5 | 30.7 |
| 36. SEQID72 | 15.4 | 23.1 | 12.9 | 25.2 | 23.2 | 16.4 | 19.2 | 22.8 | 21.6 | 20.3 | 19.1 | 18.4 | 19.5 |
| 37. SEQID74 | 29.9 | 56.6 | 30.5 | 32.7 | 65.2 | 43.7 | 48.7 | 32.4 | 57.1 | 53.8 | 51.3 | 29.9 | 29.9 |
| 38. SEQID76 | 38.9 | 39.3 | 35.8 | 29.3 | 38.4 | 43 | 43.2 | 31.7 | 38.5 | 43.2 | 45.2 | 35.9 | 38.1 |
| 39. SEQID78 | 17.9 | 28.7 | 16.7 | 38.5 | 33.4 | 20 | 26.5 | 31.2 | 27.9 | 24 | 22.6 | 25.3 | 26.9 |
| 40. SEQID80 | 23.1 | 27.6 | 19.9 | 40.4 | 31.1 | 22.9 | 24.2 | 33.7 | 28.5 | 25.9 | 24.2 | 24 | 26.6 |
| 41. SEQID82 | 20.6 | 27.9 | 21.7 | 40.1 | 33.3 | 23.5 | 27.9 | 36.6 | 27.7 | 28.2 | 25.1 | 29.5 | 30.4 |
| 42. SEQID84 | 18.7 | 27.3 | 16.7 | 31.8 | 27.2 | 17.8 | 24.2 | 30.1 | 28.3 | 23 | 20.6 | 22.8 | 25.1 |
| 43. SEQID86 | 17 | 23.9 | 15.7 | 31.2 | 23.6 | 17.9 | 22.2 | 27.7 | 23.6 | 22.9 | 20 | 22.2 | 23.6 |
| 44. SEQID88 | 14.5 | 22 | 13 | 22.9 | 22.5 | 15.2 | 19.4 | 22.1 | 20.2 | 17.1 | 17.1 | 17.3 | 18.6 |
| 45. SEQID90 | 16.3 | 23.1 | 14.2 | 23.9 | 21.3 | 15.5 | 18.9 | 23.4 | 21.2 | 20.7 | 19.2 | 17.4 | 19.4 |
| 46. SEQID94 | 13.9 | 22.9 | 14.6 | 22.6 | 21 | 16.5 | 18.9 | 24.5 | 19.8 | 18.7 | 18.9 | 17.1 | 19.4 |
| 47. SEQID96 | 14.2 | 22.6 | 13 | 23.8 | 22.6 | 15.7 | 16.4 | 23.6 | 20.7 | 19.7 | 19.2 | 15.6 | 18.8 |
| 48. SEQID100 | 19.8 | 28.4 | 20.7 | 38.1 | 27.9 | 21.4 | 25 | 35.4 | 27.3 | 26.1 | 23.6 | 26.8 | 29.7 |
| 49. SEQID102 | 29.3 | 30.5 | 26.4 | 53.7 | 27.9 | 29.6 | 29.3 | 43.8 | 29.2 | 31.6 | 33.6 | 29.3 | 44.3 |
| 50. SEQID104 | 21.4 | 28.2 | 19.9 | 37 | 29.6 | 22.1 | 27.1 | 34.5 | 29.6 | 26.4 | 24.2 | 24.6 | 29.3 |
| 51. SEQID106 | 23.4 | 31.2 | 21.3 | 43.6 | 36 | 24.1 | 25.5 | 34.4 | 26.4 | 24.5 | 25 | 22.7 | 27.5 |
| 52. SEQID108 | 21.4 | 29.8 | 20.7 | 40.5 | 29.8 | 21.6 | 26.5 | 34.7 | 25.8 | 23.4 | 23.6 | 25.6 | 27.8 |
| 53. SEQID110 | 27.5 | 30.7 | 27.2 | 56.8 | 33.2 | 33.8 | 32.2 | 36.6 | 33.3 | 38.1 | 32.6 | 27.9 | 38 |
| 54. SEQID124 | 26.3 | 29.2 | 25.1 | 44.6 | 34.5 | 30.7 | 37.2 | 52.3 | 31.1 | 38.1 | 23.5 | 29.4 | 42.4 |
| 55. SEQID126 | 28.3 | 30.2 | 26.6 | 46.3 | 33.2 | 30.1 | 30.6 | 52 | 28.7 | 36.1 | 25.9 | 30.8 | 46.9 |
| 56. SEQID134 | 24.8 | 32.8 | 23.6 | 42.9 | 35.3 | 29.6 | 36.6 | 49.5 | 32.5 | 37.5 | 24.2 | 29.9 | 40.5 |
| 57. SEQID140 | 28.6 | 28.7 | 28.2 | 46.7 | 33.7 | 30.8 | 29.7 | 50 | 29 | 27.1 | 30.9 | 29.3 | 53.8 |

| | 27 | 28 | 29 | 30 | 31 | 32 | 33 | 34 | 35 | 36 | 37 | 38 | 39 |
|---|---|---|---|---|---|---|---|---|---|---|---|---|---|
| 1. SEQID2 | 13.3 | 12.3 | 13.2 | 12.6 | 12.3 | 13.1 | 8.6 | 13.3 | 13.8 | 36.1 | 13.3 | 12.7 | 25.6 |
| 2. SEQID4 | 11.6 | 11.5 | 11.9 | 13.2 | 12.1 | 12.4 | 9 | 13.9 | 13.2 | 39.1 | 12.6 | 10.9 | 21.4 |
| 3. SEQID6 | 13.4 | 13.2 | 15.1 | 14.7 | 13.2 | 14.2 | 19 | 17.7 | 17.5 | 15.7 | 23.1 | 19.1 | 21.4 |
| 4. SEQID8 | 16.6 | 15.9 | 13.9 | 13 | 14.2 | 14.7 | 23.1 | 18.4 | 20.6 | 15.6 | 20.6 | 20.6 | 22 |
| 5. SEQID10 | 12.5 | 12.9 | 15.4 | 13.9 | 13.2 | 13.8 | 19.4 | 16.7 | 19.4 | 14.8 | 16.7 | 21 | 20.2 |
| 6. SEQID12 | 13.5 | 13.3 | 11.3 | 14.7 | 14.2 | 11.8 | 21.8 | 19 | 20.4 | 12.2 | 17.8 | 18.4 | 22.6 |
| 7. SEQID14 | 17.5 | 14 | 14 | 14 | 14.6 | 13.7 | 21.2 | 17.8 | 19.6 | 15.4 | 21.1 | 18.5 | 20.5 |
| 8. SEQID16 | 15.1 | 13 | 13.4 | 14.7 | 14.2 | 14.1 | 11 | 17.1 | 17.7 | 19.9 | 18.9 | 18.8 | 28.7 |
| 9. SEQID18 | 29.6 | 26.1 | 19.5 | 20.3 | 20.5 | 18.1 | 12.6 | 25.9 | 28.1 | 11.8 | 32.4 | 29.1 | 14.9 |
| 10. SEQID20 | 36.8 | 32.8 | 22 | 19.5 | 19.9 | 18.3 | 18.6 | 27.4 | 25.7 | 12.4 | 35.3 | 32.6 | 13.4 |
| 11. SEQID22 | 34 | 29.1 | 19.6 | 18.6 | 17.5 | 17.2 | 14.7 | 26.8 | 29.9 | 9.9 | 34 | 30.2 | 12.8 |
| 12. SEQID24 | 12.9 | 14.8 | 13.2 | 16.2 | 13.2 | 13.5 | 14.3 | 18.3 | 17.4 | 18.9 | 20.3 | 18.6 | 28.3 |
| 13. SEQID26 | 24.5 | 24.8 | 20.2 | 21 | 18.2 | 18.2 | 13.9 | 22.6 | 23.3 | 10.6 | 22.9 | 23.5 | 13.5 |
| 14. SEQID28 | 21.8 | 22.7 | 22 | 17.8 | 13.9 | 14 | 14.6 | 13 | 19.1 | 8.6 | 18.5 | 22.5 | 10.2 |
| 15. SEQID30 | 32.8 | 32.8 | 21.6 | 19.4 | 16.6 | 18.4 | 11.6 | 34.1 | 30.5 | 13.2 | 44.6 | 27.6 | 17 |
| 16. SEQID32 | 24.4 | 23.9 | 19.6 | 18.5 | 18.5 | 17.1 | 13 | 19 | 19.9 | 8.9 | 20.4 | 22.5 | 11.2 |
| 17. SEQID34 | 16.3 | 15.6 | 15.8 | 15.7 | 12.4 | 12.2 | 14.3 | 15.8 | 17.5 | 17.8 | 14.5 | 13.4 | 27.6 |
| 18. SEQID36 | 28.4 | 26.5 | 12.8 | 17.9 | 17.9 | 15.1 | 12 | 37.4 | 30.4 | 13.1 | 55.2 | 26.9 | 18.4 |
| 19. SEQID38 | 39.9 | 36.2 | 18.7 | 16.2 | 20.3 | 16.3 | 18.9 | 25.7 | 30.9 | 9.8 | 33.1 | 32.1 | 12.6 |
| 20. SEQID40 | 28.9 | 28 | 21 | 18.4 | 18.1 | 18.8 | 12.6 | 32.9 | 31.7 | 11.8 | 33.3 | 29.3 | 15 |
| 21. SEQID42 | 14.5 | 13.1 | 11.7 | 13.4 | 12.1 | 12.9 | 19.8 | 20 | 19.3 | 16.8 | 15.4 | 15.8 | 20.1 |
| 22. SEQID44 | 29.9 | 29.6 | 17.2 | 20.4 | 17.4 | 16.3 | 12.6 | 36.1 | 30.9 | 13.2 | 45 | 28.7 | 15 |
| 23. SEQID46 | 58.7 | 40.4 | 23.4 | 18.5 | 20.6 | 17.4 | 11.9 | 29.4 | 33.2 | 12.4 | 32.8 | 30.3 | 16 |
| 24. SEQID48 | 46.4 | 52.4 | 23.5 | 18.8 | 19.9 | 17.6 | 14.6 | 26.9 | 28.7 | 11.4 | 31.5 | 28.7 | 14.6 |
| 25. SEQID50 | 16.8 | 20.9 | 18.8 | 18.2 | 18.5 | 16.5 | 12.7 | 14.5 | 16.7 | 11.5 | 14.2 | 16.4 | 16.8 |
| 26. SEQID52 | 11.8 | 15.6 | 14.2 | 13.1 | 13.8 | 13.6 | 15.7 | 15.9 | 19.8 | 14.3 | 17.3 | 17.4 | 20.6 |
| 27. SEQID54 | | 41.5 | 19.9 | 20.8 | 20.8 | 16.7 | 13.9 | 24 | 28.8 | 10.8 | 31.1 | 32.7 | 14.2 |
| 28. SEQID56 | 57.1 | | 21.6 | 18.8 | 19.9 | 19.1 | 16.7 | 24.3 | 27.2 | 11.3 | 30.5 | 31.8 | 15.4 |
| 29. SEQID58 | 35.5 | 34.6 | | 24.9 | 27.1 | 24.3 | 13.1 | 16.7 | 17.8 | 11.4 | 19.7 | 19.8 | 16.3 |
| 30. SEQID60 | 34.3 | 32.7 | 35.5 | | 37.1 | 38.9 | 12.2 | 18.5 | 21.9 | 12 | 19.3 | 20.2 | 15.4 |
| 31. SEQID62 | 37.2 | 34.9 | 40.5 | 48.5 | | 72.8 | 13.1 | 19.2 | 20.8 | 11.3 | 18.2 | 17.6 | 15.4 |
| 32. SEQID64 | 34 | 33.7 | 37.3 | 54.8 | 75.7 | | 12.1 | 19.6 | 18.3 | 12.1 | 17.9 | 16.3 | 16.6 |

TABLE A1-continued

MatGAT results for global similarity and identity over the full length of the polypeptide sequences.

| | | | | | | | | | | | | | |
|---|---|---|---|---|---|---|---|---|---|---|---|---|---|
| 33. SEQID66 | 22.6 | 28.9 | 20.9 | 20.6 | 23.8 | 21.3 | | 12 | 13.2 | 7.4 | 13.5 | 15.6 | 11 |
| 34. SEQID68 | 39.2 | 33.9 | 27.4 | 33.5 | 30 | 36.6 | 19.6 | | 26.8 | 13.4 | 37.7 | 25.7 | 15.8 |
| 35. SEQID70 | 45.4 | 38.6 | 35.1 | 35.8 | 34.2 | 34.8 | 22.1 | 38.4 | | 14.4 | 29.7 | 33 | 16.8 |
| 36. SEQID72 | 19.1 | 17.9 | 19.7 | 21.8 | 18.8 | 22.9 | 12 | 20.6 | 22.5 | | 12.2 | 11 | 21.5 |
| 37. SEQID74 | 47.8 | 45.3 | 35.8 | 33.5 | 34 | 32.6 | 22.3 | 51.2 | 44.5 | 20.9 | | 30.5 | 16 |
| 38. SEQID76 | 47.7 | 47.4 | 34 | 29.9 | 31.2 | 28.2 | 24.9 | 36.8 | 44.2 | 17.4 | 43.1 | | 14.5 |
| 39. SEQID78 | 24 | 23 | 25.3 | 27.9 | 22.6 | 26.3 | 16.5 | 25.3 | 25.5 | 34.4 | 28.9 | 23.8 | |
| 40. SEQID80 | 23.3 | 24.8 | 26.3 | 30.5 | 26.6 | 29.8 | 17.7 | 32.2 | 25.5 | 32.7 | 27.4 | 22.2 | 59.9 |
| 41. SEQID82 | 27.1 | 24.4 | 28.8 | 28.8 | 25.9 | 32.6 | 20.8 | 33 | 27.3 | 32 | 30.8 | 23.3 | 46.4 |
| 42. SEQID84 | 22.3 | 21.3 | 23.4 | 27.3 | 21.7 | 21.9 | 15 | 26.8 | 25.3 | 45.3 | 21.2 | 21.9 | 39.7 |
| 43. SEQID86 | 20.3 | 20.8 | 22 | 25.5 | 20.8 | 22.4 | 15 | 27.2 | 23.8 | 48.7 | 21.7 | 20.3 | 39.8 |
| 44. SEQID88 | 17.6 | 16.4 | 19.1 | 21.7 | 17.6 | 20.3 | 11.1 | 21.2 | 19.9 | 53.9 | 18.8 | 16.8 | 32.2 |
| 45. SEQID90 | 18.4 | 18 | 19.6 | 22.3 | 17.2 | 21 | 12.7 | 21.7 | 20.2 | 56 | 18.5 | 18.5 | 34.4 |
| 46. SEQID94 | 17.3 | 18.5 | 18.1 | 20.7 | 17.2 | 19.8 | 11.6 | 22.3 | 21.2 | 52.6 | 19.5 | 17.1 | 32.1 |
| 47. SEQID96 | 16.9 | 16.4 | 19.3 | 20.5 | 18.2 | 20.3 | 12.1 | 22.8 | 21.7 | 54.5 | 20.2 | 17.7 | 31.4 |
| 48. SEQID100 | 27 | 27.3 | 24.8 | 27.3 | 24.3 | 26.4 | 18.7 | 29.3 | 27.3 | 43.1 | 27.7 | 23.6 | 39.3 |
| 49. SEQID102 | 31.7 | 27.1 | 27.7 | 26.6 | 27.5 | 24 | 26.4 | 26.9 | 31.3 | 32.4 | 27.7 | 32.1 | 32.8 |
| 50. SEQID104 | 25.3 | 27.3 | 27.3 | 29.8 | 24.6 | 27.5 | 17.4 | 28.2 | 25.1 | 43.3 | 29.1 | 26.2 | 41.3 |
| 51. SEQID106 | 25 | 25.5 | 25.9 | 26.1 | 23.4 | 28 | 17.9 | 34.2 | 25 | 31.7 | 32.6 | 25.7 | 46.6 |
| 52. SEQID108 | 22.7 | 23.8 | 24.5 | 27.2 | 25.6 | 27.6 | 18 | 28.7 | 28.1 | 31.8 | 27.4 | 25.2 | 66.6 |
| 53. SEQID110 | 31.7 | 33.8 | 27.7 | 26.6 | 27.9 | 28.7 | 22.6 | 31.1 | 32.4 | 23.8 | 38.1 | 36.2 | 36 |
| 54. SEQID124 | 31.6 | 27.6 | 25.1 | 26.6 | 24.8 | 30.1 | 28.5 | 32.1 | 36 | 23.5 | 39.3 | 35.3 | 31.4 |
| 55. SEQID126 | 31.4 | 31.8 | 29.3 | 26.9 | 30.2 | 29.3 | 36 | 32.9 | 32.4 | 23.6 | 37.4 | 29.7 | 31.8 |
| 56. SEQID134 | 27.8 | 25.4 | 27.5 | 25.9 | 32.9 | 27.6 | 32.6 | 30.5 | 36.3 | 25.2 | 37.2 | 35 | 35 |
| 57. SEQID140 | 33.4 | 30.4 | 26.5 | 24.4 | 27.9 | 27.9 | 32.7 | 30.3 | 32.7 | 22.7 | 33.3 | 36.1 | 31.4 |

| | 40 | 41 | 42 | 43 | 44 | 45 | 46 | 47 | 48 | 49 | 50 | 51 | 52 |
|---|---|---|---|---|---|---|---|---|---|---|---|---|---|
| 1. SEQID2 | 25.3 | 22.4 | 39.5 | 38.3 | 41.7 | 41.1 | 39.7 | 37.9 | 38.3 | 22.4 | 36.5 | 23.8 | 23.8 |
| 2. SEQID4 | 23.7 | 23.1 | 38.8 | 39.6 | 46.7 | 46.9 | 45.1 | 43.1 | 37.5 | 21.2 | 37.8 | 22.2 | 23.5 |
| 3. SEQID6 | 22.7 | 22.3 | 17.9 | 17.9 | 14.3 | 15.1 | 15.6 | 14.5 | 22.4 | 29 | 20.3 | 25.2 | 22.3 |
| 4. SEQID8 | 22.5 | 25 | 19.4 | 18 | 15.3 | 15.4 | 15.4 | 15.2 | 23.5 | 25.1 | 21 | 24.7 | 22 |
| 5. SEQID10 | 21.9 | 21.9 | 18.7 | 15.5 | 13 | 12.9 | 13.4 | 13.3 | 20.4 | 30.3 | 21.3 | 23.6 | 20.8 |
| 6. SEQID12 | 22.8 | 24.3 | 17.6 | 18 | 14.1 | 14.6 | 14.2 | 15.9 | 20.9 | 28 | 20.7 | 25.8 | 21.4 |
| 7. SEQID14 | 22.7 | 23.9 | 18.6 | 17.7 | 14 | 14.6 | 14.1 | 14.6 | 22.7 | 30.1 | 21.6 | 23.2 | 23.8 |
| 8. SEQID16 | 28.2 | 31 | 25.7 | 23.4 | 17.9 | 18.4 | 18.2 | 18.9 | 26.9 | 31.3 | 25.6 | 31 | 30.8 |
| 9. SEQID18 | 14.3 | 14.4 | 12.7 | 12.2 | 10.5 | 11.2 | 12 | 10.9 | 14.1 | 14.9 | 14.6 | 13.8 | 14.5 |
| 10. SEQID20 | 14.7 | 15.9 | 11.9 | 12.1 | 11.2 | 10.4 | 12.6 | 10.6 | 14.1 | 17.1 | 13 | 13.8 | 13.3 |
| 11. SEQID22 | 14.2 | 15.2 | 13.9 | 11.5 | 10.9 | 9.8 | 11.2 | 10.8 | 12.5 | 16.6 | 13.1 | 15.9 | 14.3 |
| 12. SEQID24 | 27.5 | 29.8 | 23.5 | 21.4 | 17.3 | 17.1 | 17.2 | 17.8 | 25.3 | 31.1 | 24 | 30.2 | 30.1 |
| 13. SEQID26 | 13.8 | 16.9 | 13.5 | 14.1 | 11.8 | 11.6 | 10.4 | 10.9 | 15.3 | 12.5 | 15.6 | 15.3 | 15.1 |
| 14. SEQID28 | 14 | 11.5 | 11.8 | 11 | 9.6 | 9.7 | 9.5 | 8.5 | 13.1 | 15.3 | 12.4 | 12.4 | 12.2 |
| 15. SEQID30 | 16.1 | 15.9 | 13.4 | 14.2 | 13.6 | 13.8 | 12.7 | 12.3 | 14.9 | 15.9 | 16.6 | 13.7 | 14.7 |
| 16. SEQID32 | 11.7 | 12.2 | 11.2 | 10.7 | 7.6 | 8.4 | 8.8 | 8.5 | 11 | 13.9 | 12.8 | 12.4 | 12.5 |
| 17. SEQID34 | 28 | 29.4 | 22.7 | 21.6 | 16.8 | 18 | 16.8 | 16.8 | 28.3 | 33.2 | 26.2 | 33.3 | 29.5 |
| 18. SEQID36 | 17.4 | 19.2 | 14.7 | 13.4 | 13 | 12.6 | 11.8 | 13.1 | 16.4 | 15.5 | 15.3 | 19.5 | 16.4 |
| 19. SEQID38 | 12.7 | 12.8 | 10.5 | 12.4 | 9.5 | 9.4 | 10.1 | 10.2 | 14.2 | 13.7 | 14.2 | 14.4 | 12.7 |
| 20. SEQID40 | 15.1 | 14.6 | 13.4 | 12.4 | 12.5 | 11.2 | 11.2 | 9.9 | 14 | 16.2 | 16.1 | 15.1 | 14.9 |
| 21. SEQID42 | 22.6 | 21.5 | 19.5 | 18.5 | 15.5 | 16.6 | 16.6 | 15.7 | 23.2 | 28.2 | 23.2 | 22 | 23.1 |
| 22. SEQID44 | 14.4 | 15.6 | 15.6 | 14.8 | 13.5 | 12.6 | 13.1 | 12.5 | 13.9 | 15.5 | 18.1 | 13.9 | 13.5 |
| 23. SEQID46 | 16.1 | 16.9 | 14.2 | 14.8 | 11.6 | 13.1 | 10.1 | 12.4 | 14.6 | 16.7 | 14.8 | 15.8 | |
| 24. SEQID48 | 14 | 14.6 | 13.2 | 12.6 | 10.4 | 12 | 10.8 | 11.9 | 13.5 | 16.1 | 13.1 | 14.6 | 14.5 |
| 25. SEQID50 | 14.5 | 14.5 | 14 | 14.1 | 11.2 | 11.3 | 9.6 | 9.6 | 12.9 | 15 | 13.7 | 13.1 | 16.8 |
| 26. SEQID52 | 18.6 | 19.7 | 18.3 | 17 | 12.6 | 13.8 | 13.9 | 13.9 | 20.4 | 26 | 20.9 | 19.5 | 20.9 |
| 27. SEQID54 | 14.5 | 14.4 | 14.9 | 13.7 | 10.6 | 11.2 | 10.4 | 10.5 | 14.8 | 11.9 | 14 | 12.8 | 14.3 |
| 28. SEQID56 | 15.9 | 13.3 | 12.7 | 12 | 11.1 | 11.5 | 11.5 | 9.8 | 16.4 | 11.7 | 17 | 14.4 | 15.1 |
| 29. SEQID58 | 15.1 | 14.4 | 13.5 | 13.1 | 10.5 | 12 | 10.8 | 11.5 | 13.7 | 15.3 | 15.9 | 16.1 | 14.3 |
| 30. SEQID60 | 15.5 | 13.5 | 12.2 | 12.1 | 12.5 | 11.6 | 12.6 | 12.3 | 11.9 | 14.1 | 13.5 | 12.4 | 13.7 |
| 31. SEQID62 | 12.5 | 12 | 11.8 | 12 | 9.8 | 10.4 | 10.8 | 10.9 | 12.1 | 12.8 | 13.9 | 11.6 | 14.9 |
| 32. SEQID64 | 15.3 | 16 | 11.3 | 13.4 | 11.6 | 12.6 | 13.4 | 11.3 | 13.3 | 13.2 | 14.1 | 13.8 | 15.8 |
| 33. SEQID66 | 11 | 12.4 | 9.9 | 9.5 | 7.8 | 7.7 | 8.1 | 8.1 | 12.2 | 13.9 | 10.8 | 11 | 11.6 |
| 34. SEQID68 | 18 | 18.4 | 15.8 | 14.3 | 13.8 | 13.4 | 14.2 | 12.7 | 17.5 | 17 | 17.2 | 18.7 | 16.2 |
| 35. SEQID70 | 15.9 | 15.5 | 13.6 | 14.6 | 12.2 | 10.7 | 12.8 | 13.3 | 15.1 | 16.8 | 17.1 | 13.9 | 15.5 |
| 36. SEQID72 | 22 | 21.2 | 35.1 | 35.3 | 40 | 40 | 37.9 | 39.8 | 34 | 29 | 34.4 | 22.2 | 22.3 |
| 37. SEQID74 | 16.7 | 17.2 | 12.5 | 13.9 | 12 | 12 | 11.4 | 11.9 | 16.6 | 13 | 17.3 | 17.9 | 15 |
| 38. SEQID76 | 13 | 11.5 | 13.9 | 12.9 | 10.7 | 11.5 | 9.6 | 11.4 | 14.2 | 13.3 | 16.4 | 14.6 | 16.9 |
| 39. SEQID78 | 46.4 | 32.7 | 25.1 | 25.5 | 22.1 | 24 | 21.9 | 21 | 26.3 | 24 | 26.6 | 33.5 | 58.2 |
| 40. SEQID80 | | 31.2 | 27.1 | 25.2 | 20.9 | 22.4 | 21.9 | 22.3 | 21.4 | 29.1 | 24.6 | 33.8 | 47 |
| 41. SEQID82 | 49.2 | | 24.5 | 25.9 | 20 | 20.3 | 20.1 | 19.9 | 27.6 | 25.8 | 26.9 | 33.1 | 31.8 |
| 42. SEQID84 | 40.8 | 38.6 | | 71.1 | 36 | 36.3 | 35.8 | 36 | 43.5 | 26.2 | 41.9 | 27.1 | 27.1 |
| 43. SEQID86 | 38.7 | 37.7 | 79.7 | | 35.5 | 37.9 | 38 | 36.8 | 40 | 24.4 | 41 | 26.2 | 26.9 |
| 44. SEQID88 | 32.4 | 30.6 | 45.6 | 46.1 | | 64.6 | 55.8 | 53.6 | 34.5 | 19 | 33.7 | 21.1 | 20.1 |
| 45. SEQID90 | 32.5 | 32.2 | 46.6 | 49.7 | 73 | | 51.3 | 51.7 | 35.1 | 20.1 | 34.9 | 22.3 | 24 |
| 46. SEQID94 | 31.8 | 32.9 | 47.6 | 51.2 | 67.6 | 65.5 | | 49.7 | 34.8 | 19.4 | 33.7 | 21.5 | 21.3 |
| 47. SEQID96 | 30.7 | 30.1 | 45.8 | 46.3 | 66.7 | 64.2 | 63.4 | | 34.3 | 18.9 | 34.4 | 21.6 | 21.7 |
| 48. SEQID100 | 42.1 | 42.1 | 54.3 | 50.1 | 42.8 | 43.8 | 42.4 | 42.9 | | 29.7 | 72.2 | 28.3 | 28.2 |
| 49. SEQID102 | 35.2 | 36.4 | 33 | 31.2 | 25.5 | 25.9 | 25.2 | 24.4 | 41.2 | | 29.6 | 25.5 | 26.9 |

TABLE A1-continued

MatGAT results for global similarity and identity over the full length of the polypeptide sequences.

| | | | | | | | | | | | | | |
|---|---|---|---|---|---|---|---|---|---|---|---|---|---|
| 50. SEQID104 | 44.1 | 42.6 | 51.7 | 49.7 | 41 | 44 | 41.9 | 42.5 | 81.3 | 39.5 | | 27.7 | 27.3 |
| 51. SEQID106 | 50.3 | 51.7 | 39.3 | 36.7 | 30.3 | 31.1 | 32.3 | 31.6 | 43.7 | 36.2 | 39.5 | | 34.7 |
| 52. SEQID108 | 61.3 | 49 | 38.2 | 39.1 | 28.9 | 33.2 | 31.3 | 32.3 | 43.9 | 37.2 | 41.2 | 48.6 | |
| 53. SEQID110 | 34.6 | 39 | 30.1 | 28.2 | 21.1 | 23.1 | 23.5 | 22.4 | 34.2 | 51.6 | 33.9 | 51.6 | 37 |
| 54. SEQID124 | 33.5 | 35.3 | 30.7 | 28.1 | 22.8 | 24.3 | 21.8 | 24 | 34 | 42.4 | 35.7 | 37.2 | 35.9 |
| 55. SEQID126 | 31.7 | 37 | 30 | 28.4 | 24.1 | 23.1 | 22.2 | 22.2 | 34.7 | 50.3 | 34.8 | 35.1 | 34.5 |
| 56. SEQID134 | 36.1 | 37.5 | 32.6 | 30.8 | 24.3 | 24.8 | 24.5 | 23.8 | 34.2 | 41.7 | 34.1 | 37.8 | 36.1 |
| 57. SEQID140 | 31.1 | 33.5 | 28.8 | 27.2 | 20.1 | 22.3 | 22.3 | 19.2 | 32.9 | 50 | 31.8 | 33.3 | 32.7 |

| | 53 | 54 | 55 | 56 | 57 |
|---|---|---|---|---|---|
| 1. SEQID2 | 18 | 19.6 | 18.5 | 17 | 17.6 |
| 2. SEQID4 | 17.2 | 15.7 | 15.6 | 17.1 | 16.4 |
| 3. SEQID6 | 28.9 | 47.3 | 48.4 | 44.6 | 59.7 |
| 4. SEQID8 | 26.8 | 60.2 | 52.8 | 53.3 | 44.8 |
| 5. SEQID10 | 29.8 | 47.5 | 49 | 46.9 | 46.2 |
| 6. SEQID12 | 28.7 | 50 | 46.1 | 51.1 | 45.8 |
| 7. SEQID14 | 27.8 | 46.1 | 51.8 | 46.2 | 65.2 |
| 8. SEQID16 | 34.1 | 29.2 | 25.6 | 27.3 | 27.1 |
| 9. SEQID18 | 18.7 | 15.1 | 15.3 | 17.9 | 15.1 |
| 10. SEQID20 | 19.3 | 15 | 15.9 | 13.9 | 14.2 |
| 11. SEQID22 | 18.5 | 17.7 | 16.5 | 19.2 | 17.4 |
| 12. SEQID24 | 32.9 | 30.8 | 25.7 | 27.8 | 26.3 |
| 13. SEQID26 | 19.4 | 20.6 | 18.1 | 19.7 | 19.3 |
| 14. SEQID28 | 13.4 | 14.2 | 17 | 15 | 13.5 |
| 15. SEQID30 | 19.8 | 16.7 | 18.4 | 18.6 | 15.6 |
| 16. SEQID32 | 13.1 | 15.2 | 14.9 | 12.4 | 13.8 |
| 17. SEQID34 | 40.1 | 27.9 | 30.1 | 25.7 | 30.2 |
| 18. SEQID36 | 19 | 19.7 | 17.8 | 19.7 | 19.4 |
| 19. SEQID38 | 19 | 18.8 | 16.1 | 18.4 | 18.1 |
| 20. SEQID40 | 17.9 | 19.3 | 13.7 | 19.4 | 16.2 |
| 21. SEQID42 | 24.3 | 36.4 | 33.9 | 35.3 | 35.8 |
| 22. SEQID44 | 19 | 17.9 | 16.8 | 17.9 | 17.8 |
| 23. SEQID46 | 20.5 | 19.6 | 19 | 18.4 | 15.6 |
| 24. SEQID48 | 15.1 | 12.1 | 14.2 | 11.4 | 14.5 |
| 25. SEQID50 | 12.6 | 14.6 | 16.1 | 16.6 | 16.8 |
| 26. SEQID52 | 25.2 | 30 | 30.8 | 28.6 | 36.3 |
| 27. SEQID54 | 15.6 | 14.2 | 17.2 | 14.4 | 15.5 |
| 28. SEQID56 | 18.2 | 13.9 | 13.8 | 14.1 | 13.1 |
| 29. SEQID58 | 13.2 | 12.2 | 15 | 10.9 | 14 |
| 30. SEQID60 | 15.8 | 14 | 14.2 | 14.1 | 13.4 |
| 31. SEQID62 | 12.2 | 13.9 | 15.1 | 14.9 | 15.2 |
| 32. SEQID64 | 13.9 | 13.7 | 14 | 10.9 | 14.3 |
| 33. SEQID66 | 12.1 | 23.1 | 28.8 | 22.8 | 19.5 |
| 34. SEQID68 | 18.7 | 19 | 17.4 | 17.8 | 17.8 |
| 35. SEQID70 | 18.6 | 20.1 | 20.5 | 20 | 19.4 |
| 36. SEQID72 | 17 | 15.2 | 16 | 16.3 | 14.6 |
| 37. SEQID74 | 21.2 | 19.9 | 21.6 | 20.2 | 20.2 |
| 38. SEQID76 | 21.3 | 21.5 | 14.9 | 20.6 | 16.8 |
| 39. SEQID78 | 25.9 | 22.6 | 21.8 | 22.5 | 22.2 |
| 40. SEQID80 | 25.5 | 22.6 | 21.6 | 24.3 | 23.3 |
| 41. SEQID82 | 29.2 | 22 | 22.8 | 24.2 | 22.4 |
| 42. SEQID84 | 21.6 | 19.1 | 19.9 | 19.5 | 18.7 |
| 43. SEQID86 | 19.3 | 17.9 | 17.9 | 18.1 | 17.2 |
| 44. SEQID88 | 15.6 | 14.7 | 15.1 | 15.3 | 14.4 |
| 45. SEQID90 | 16.2 | 14.8 | 15.9 | 15.4 | 14.7 |
| 46. SEQID94 | 17.3 | 14.5 | 14.9 | 15.7 | 14.1 |
| 47. SEQID96 | 16.8 | 15 | 15.1 | 14.8 | 13.4 |
| 48. SEQID100 | 24.2 | 21.2 | 24 | 20.7 | 21.1 |
| 49. SEQID102 | 33.3 | 26.1 | 28.2 | 25.9 | 30.2 |
| 50. SEQID104 | 22.8 | 21.8 | 24 | 21.5 | 22 |
| 51. SEQID106 | 46.2 | 23.5 | 24.1 | 25.3 | 22 |
| 52. SEQID108 | 25.9 | 22.8 | 23.8 | 22.2 | 23.2 |
| 53. SEQID110 | | 27.4 | 29.2 | 27.4 | 27.9 |
| 54. SEQID124 | 44 | | 54.2 | 54.9 | 44 |
| 55. SEQID126 | 44.6 | 64.1 | | 54.5 | 49.8 |
| 56. SEQID134 | 40.8 | 68 | 65.6 | | 43.8 |
| 57. SEQID140 | 41.8 | 55.1 | 59.8 | 52.6 | |

Example 4

Identification of Domains Comprised in CCA1

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Pro- Dom and Pfam, Smart and TIGRFAMs. Interpro is hosted at the European Bioinformatics Institute in the United Kingdom.

The results of the InterPro scan of the polypeptide sequence as represented by SEQ ID NO: 2 are presented in Table A2.

TABLE A2

InterPro scan results of the polypeptide sequence as represented by SEQ ID NO: 2

| Database | Accession number | Accession name |
|---|---|---|
| Interpro | IPR001005 | Myb, DNA-binding |
| PFAM | PF00249 | Myb_DNA-binding |
| SMART | SM00717 | SANT domain |
| PROFILE | PS50090 | MYB_3 |
| Interpro | IPR006447 | Myb-like DNA-binding region, SHAQKYF class |
| TIGRFAMs | TIGR01557 | myb_SHAQKYF |
| Interpro | IPR009057 | Homeodomain-like |
| SUPERFAMILY | SSF46689 | Homeodomain_like |

Example 5

Topology Prediction of the Polypeptide Sequences Useful in Performing the Methods of the Invention (Subcellular Localization, Transmembrane . . . )

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 2 are presented Table A3. The "plant" organism group has been selected, no cutoffs defined, and the predicted length of the transit peptide requested. The subcellular localization of the polypeptide sequence as represented by SEQ ID NO: 2 is likely the cytoplasm or nucleus. However, it should be noticed that the observed effects on yield as described in the present application are not the result of a particular localisation of the protein.

TABLE A3

TargetP 1.1 analysis of the polypeptide sequence as represented by SEQ ID NO: 2

| Length (AA) | 608 |
|---|---|
| Chloroplastic transit peptide | 0.160 |
| Mitochondrial transit peptide | 0.149 |
| Secretory pathway signal peptide | 0.027 |
| Other subcellular targeting | 0.900 |

TABLE A3-continued

TargetP 1.1 analysis of the polypeptide sequence as represented by SEQ ID NO: 2

| Predicted Location | other |
|---|---|
| Reliability class | 2 |
| Predicted transit peptide length | / |

Many other algorithms can be used to perform such analyses, including:
- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark

Example 6

Assay Related to the CCA1 Polypeptide Sequences

CCA1-like proteins (at least in their native form) typically have DNA binding activity. DNA binding assays are part of the state of the art (see for example Current Protocols in Molecular Biology, Volumes 1 and 2, Ausubel et al. (1994), Current Protocols). In particular, a DNA binding assay for CCA1-like transcription factors using the A2 fragment of the Lhcb1*3 gene is described in Wang et al. (Plant Cell 9, 497-507, 1197). Briefly, polypeptides comprising the MYB repeat were expressed and purified, and used in an Electrophoretic Mobility Shift Assay (EMSA). The purified polypeptides were incubated with radiolabeled and purified A2 fragment of the Lhcb1*3 gene and poly (dIdC) during 15 minutes at 30° C. Next, the samples were separated on a 8% polyacrylamide gel and autoradiographed. Protein bands corresponding to CCA1 clearly bound radioactive probe, indicative of the formation of a protein-DNA complex.

Furthermore, overexpression of a CCA1-like protein in a plant leads to delayed flowering and abolishes the circadian expression of Lhcb or other circadianly expressed genes in continuous light or continuous dark conditions. Alternatively, expression of a CCA1-like protein according to the methods of the present invention results in increased seed yield as described below.

Example 7

Cloning of Nucleic Acid Sequence as Represented by SEQ ID NO: 1

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Arabidopsis thaliana* CCA1-like gene was amplified by PCR using as template an *Arabidopsis thaliana* seedling cDNA library (Invitrogen, Paisley, UK). Primers prm07263 (SEQ ID NO: 146; sense, start codon in bold, AttB1 site in italic: 5'-ggggacaagtttgtacaaaaaagcag-gcttaaacaatggagacaaattcgtctgga-3') and prm07264: (SEQ ID NO: 147; reverse, complementary, AttB2 site in italic: 5'-ggg-gaccactttgtacaagaaagctgggtgaaaatagagtctcatgtggaagc-3'), which include the AttB sites for Gateway recombination, were used for PCR amplification. PCR was performed using Hifi Taq DNA polymerase in standard conditions. A PCR fragment was amplified and purified also using standard methods. The first step of the Gateway procedure, the BP reaction, was then performed, during which the PCR fragment recombines in vivo with the pDONR201 plasmid to produce, according to the Gateway terminology, an "entry clone", pCCA1. Plasmid pDONR201 was purchased from Invitrogen, as part of the Gateway® technology.

Example 8

Expression Vector Construction Using the Nucleic Acid Sequence as Represented by SEQ ID NO: 1

The entry clone pCCA1 was subsequently used in an LR reaction with pGOS2, a destination vector used for *Oryza sativa* transformation. This vector contains as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 145) for constitutive expression was located upstream of this Gateway cassette.

Figure 3:
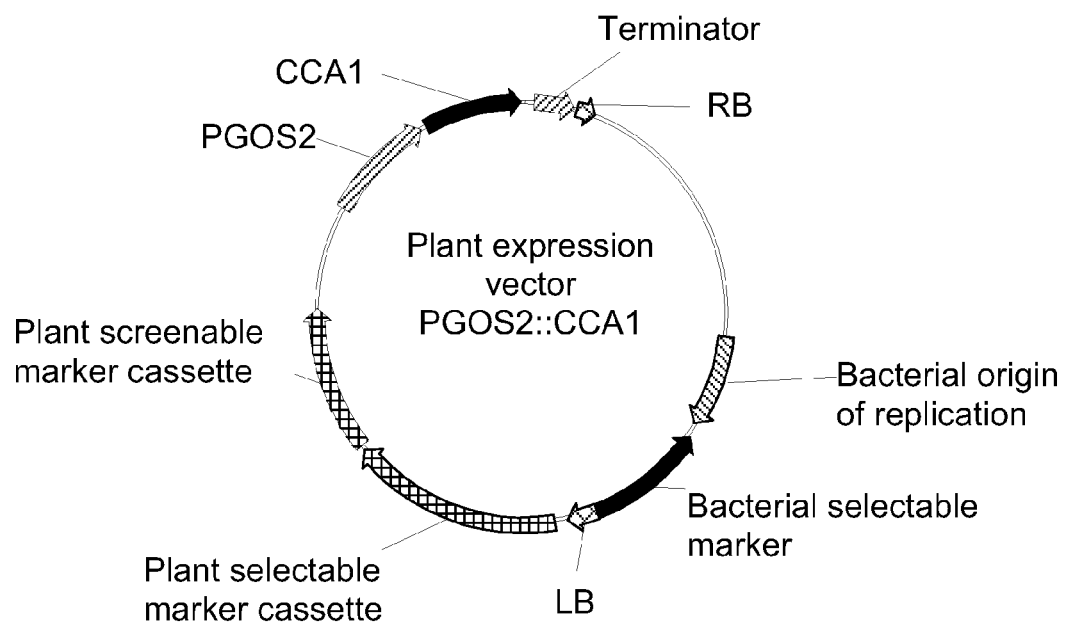
FIG. 3 shows the binary vector for increased expression in *Oryza sativa* of an *Arabidopsis thaliana* CCA1-like protein-encoding nucleic acid under the control of a GOS2 promoter.

After the LR recombination step, the resulting expression vector pGOS2::CCA1 (FIG. 3) was transformed into *Agrobacterium* strain LBA4044 according to methods well known in the art.

Example 9

Plant Transformation

Rice Transformation
The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Corn Transformation
Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation
Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation
Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 10

Phenotypic Evaluation Procedure 10.1 Evaluation Setup

Approximately 35 independent T0 rice transformants were generated. The primary transformants were transferred from a tissue culture chamber to a greenhouse for growing and harvest of T1 seed. Seven events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

10.2 Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and to verify for an overall effect of the gene, also known as a global gene effect. The threshold for significance for a true global gene effect was set at a 5% probability level for the F-test. A significant F-test value points to a gene effect, meaning that it is not only the mere presence or position of the gene that is causing the differences in phenotype.

10.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area (mm$^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 11

Results of the Phenotypic Evaluation of the Transgenic Plants

The results of the evaluation of transgenic rice plants expressing the CCA1 nucleic acid sequence are presented in Table A4. The percentage difference between the transgenics and the corresponding nullizygotes is also shown, with a P value from the F test below 0.05.

Total seed yield, number of filled seeds, seed fill rate and harvest index are significantly increased in the transgenic plants expressing the nucleic acid sequence useful in performing the methods of the invention, compared to the control plants (in this case, the nullizygotes).

TABLE A4

Results of the evaluation of transgenic rice plants expressing the nucleic acid sequence useful in performing the methods of the invention.

| Trait | % Increase in T1 generation | % Increase in T2 generation |
| --- | --- | --- |
| Total seed yield | 26.7 | 38.6 |
| Number of filled seeds | 22.9 | 28.6 |
| Fill rate | 11.2 | 9.6 |
| Harvest index | 15.4 | 15.6 |
| Flowers per panicle | 16.5 | 16.9 |
| Thousand Kernel Weight | 2.7 | 7.2 |

Part II. VPE

Example 12

Identification of Sequences Related to VPE Sequences of SEQ ID NO: 149 and SEQ ID NO: 150

Sequences (full length cDNA, ESTs or genomic) related to SEQ ID NO: 149 and/or protein sequences related to SEQ ID NO: 150 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. The polypeptide encoded by SEQ ID NO: 149 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity (percentage identity referring to the number of identical nucleotides (or amino acids) between the two compared nucleic acid (or polypeptide) sequences over a particular length). In some instances, the default parameters were adjusted to modify the stringency of the search.

Table B1 provides a list of nucleic acid and protein sequences related to the nucleic acid sequence as represented by SEQ ID NO: 149 and the protein sequence represented by SEQ ID NO: 150.

TABLE B1

Nucleic acid sequences related to SEQ ID NO: 149 and corresponding deduced polypeptides.

| Name | SEQ ID NO: | Nucleotide (Nt) or protein (PROT) | Origin |
|---|---|---|---|
| VPEg | SEQ ID NO: 149 | Nt | *Arabidopsis thaliana* |
| VPEg | SEQ ID NO: 150 | PROT | *Arabidopsis thaliana* |
| >TA0704@contig9701 | SEQ ID NO: 151 | Nt | *Triticum aestivum* |
| >TA0704@contig9701 | SEQ ID NO: 152 | PROT | *Triticum aestivum* |
| >TA0704@contig15207 | SEQ ID NO: 153 | Nt | *Triticum aestivum* |
| >TA0704@contig15207 | SEQ ID NO: 154 | PROT | *Triticum aestivum* |
| >TA0704@contig14121 | SEQ ID NO: 155 | Nt | *Triticum aestivum* |
| >TA0704@contig14121 | SEQ ID NO: 156 | PROT | *Triticum aestivum* |
| >TA0704@contig11093 | SEQ ID NO: 157 | Nt | *Triticum aestivum* |
| >TA0704@contig11093 | SEQ ID NO: 158 | PROT | *Triticum aestivum* |
| >HV0704@contig6924 | SEQ ID NO: 159 | Nt | *Hordeum vulgare* |
| >HV0704@contig6924 | SEQ ID NO: 160 | PROT | *Hordeum vulgare* |
| >GM0604@contig24378 | SEQ ID NO: 161 | Nt | *Glycine max* |
| >GM0604@contig24378 | SEQ ID NO: 162 | PROT | *Glycine max* |
| >GM0604@contig20207 | SEQ ID NO: 163 | Nt | *Glycine max* |
| >GM0604@contig20207 | SEQ ID NO: 164 | PROT | *Glycine max* |
| >GM0604@contig13648 | SEQ ID NO: 165 | Nt | *Glycine max* |
| >GM0604@contig13648 | SEQ ID NO: 166 | PROT | *Glycine max* |
| >BN0204@contig29409 | SEQ ID NO: 167 | Nt | *Brassica napa* |
| >BN0204@contig29409 | SEQ ID NO: 168 | PROT | *Brassica napa* |
| >BN0204@contig26590 | SEQ ID NO: 169 | Nt | *Brassica napa* |
| >BN0204@contig26590 | SEQ ID NO: 170 | PROT | *Brassica napa* |
| >ZM0404@contig11971 | SEQ ID NO: 171 | Nt | *Zea mays* |
| >ZM0404@contig11971 | SEQ ID NO: 172 | PROT | *Zea mays* |
| >AT2G25940 Alpha-VPE | SEQ ID NO: 173 | Nt | *Arabidopsis thaliana* |
| >AT2G25940 Alpha-VPE | SEQ ID NO: 174 | PROT | *Arabidopsis thaliana* |
| >AT1G62710 BETA-VPE | SEQ ID NO: 175 | Nt | *Arabidopsis thaliana* |
| >AT1G62710 BETA-VPE | SEQ ID NO: 176 | PROT | *Arabidopsis thaliana* |
| >AT3G20210 DELTA-VPE | SEQ ID NO: 177 | Nt | *Arabidopsis thaliana* |
| >AT3G20210 DELTA-VPE | SEQ ID NO: 178 | PROT | *Arabidopsis thaliana* |
| >Os01g0559600 | SEQ ID NO: 179 | Nt | *Oryza sativa* |
| >Os01g0559600 | SEQ ID NO: 180 | PROT | *Oryza sativa* |
| >Os02g0644000 | SEQ ID NO: 181 | Nt | *Oryza sativa* |
| >Os02g0644000 | SEQ ID NO: 182 | PROT | *Oryza sativa* |
| >Os04g0537900 | SEQ ID NO: 183 | Nt | *Oryza sativa* |
| >Os04g0537900 | SEQ ID NO: 184 | PROT | *Oryza sativa* |
| >Os05g0593900 | SEQ ID NO: 185 | Nt | *Oryza sativa* |
| >Os05g0593900 | SEQ ID NO: 186 | PROT | *Oryza sativa* |
| >lcl_scaff_127.44 | SEQ ID NO: 187 | Nt | *Populus trichocarpa* |
| >lcl_scaff_127.44 | SEQ ID NO: 188 | PROT | *Populus trichocarpa* |
| >lcl_scaff_VI.1657 | SEQ ID NO: 189 | Nt | *Populus trichocarpa* |
| >lcl_scaff_VI.1657 | SEQ ID NO: 190 | PROT | *Populus trichocarpa* |
| >lcl_scaff_VIII.21 | SEQ ID NO: 191 | Nt | *Populus trichocarpa* |
| >lcl_scaff_VIII.21 | SEQ ID NO: 192 | PROT | *Populus trichocarpa* |
| >Le_CAH56498.1_VPEg | SEQ ID NO: 193 | Nt | *Solanum lycopersicum* |
| >Le_CAH56498.1_VPEg | SEQ ID NO: 194 | PROT | *Solanum lycopersicum* |
| >Nt_BAC54827.1 VPEg | SEQ ID NO: 195 | Nt | *Nicotiana tabacum* |
| >Nt_BAC54827.1 VPEg | SEQ ID NO: 196 | PROT | *Nicotiana tabacum* |
| >So_ABF00019.1_VPEg | SEQ ID NO: 197 | Nt | *Saccharum officinarum* |
| >So_ABF00019.1_VPEg | SEQ ID NO: 198 | PROT | *Saccharum officinarum* |
| >Zm_See2a | SEQ ID NO: 199 | Nt | *Zea mays* |
| >Zm_See2a | SEQ ID NO: 200 | PROT | *Zea mays* |
| >Zm_See2b | SEQ ID NO: 201 | Nt | *Zea mays* |
| >Zm_See2b | SEQ ID NO: 202 | PROT | *Zea mays* |
| >Zm_VPE1 | SEQ ID NO: 203 | Nt | *Zea mays* |
| >Zm_VPE1 | SEQ ID NO: 204 | PROT | *Zea mays* |

Example 13

Alignment of VPEs

AlignX from Vector NTI (Invitrogen), based on the popular Clustal algorithm of progressive alignment (Thompson et al. (1997) Nucleic Acids Res 25: 4876-4882; Chenna et al. (2003). Nucleic Acids Res 31: 3497-3500) was used for the alignment of VPE sequences. A phylogenetic tree was constructed using a neighbour-joining clustering algorithm. Default values were used for the gap open penalty of 10, for the gap extension penalty of 0.1 and the selected weight matrix was Blosum 62.

Figures 5, 6:
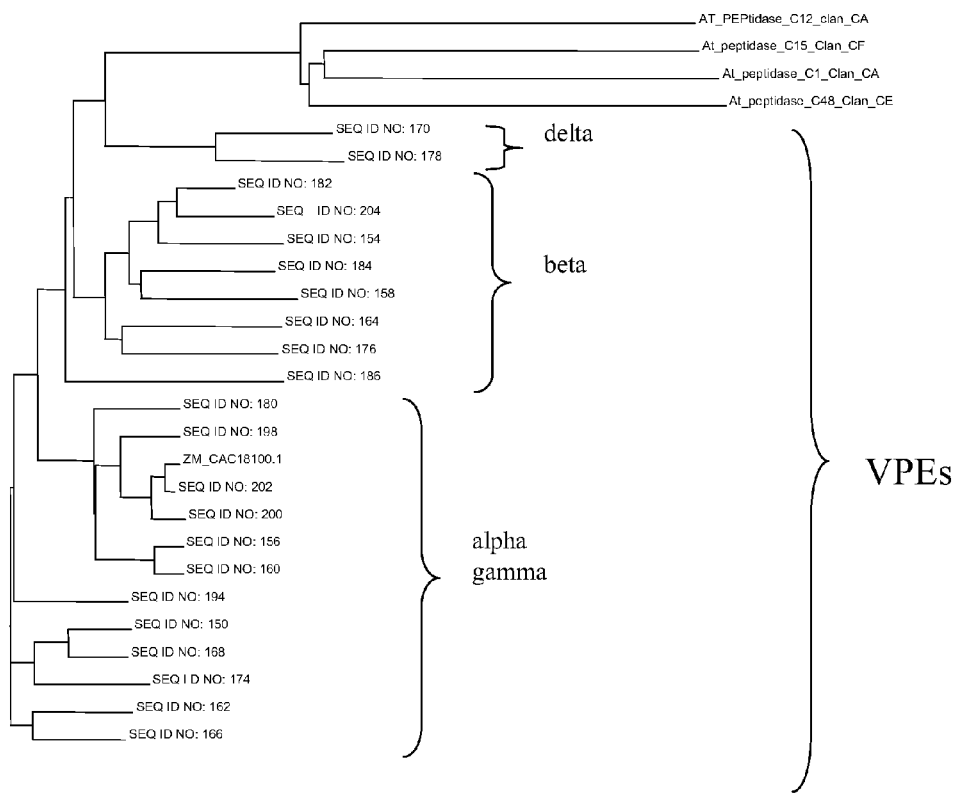
FIG. 5 shows the domain structure of a gamma VPE.

The result of the multiple sequence alignment performed with AlignX from the Vector NTI (Invitrogen) using default parameters is shown in FIG. 6B. A multiple sequence alignment and the corresponding the phylogenetic tree of VPE polypeptides and peptidases representative of other protein clans was performed using the AlignX from the Vector NTI (Invitrogen) set to default parameters (FIG. 6A). VPE polypeptides cluster together, apart from peptidases belonging a different clan. VPE polypeptides cluster in four subclasses. VPEs in class alpha are the closest to VPEs in class gamma, the class to which SEQ ID NO: 150 belongs.

Example 14

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table B2 for the global similarity and identity over the full length of the polypeptide sequences (excluding the partial polypeptide sequences). Percentage identity is given above the diagonal and percentage similarity is given below the diagonal.

The percentage identity between VPEs start at about 45% amino acid identity compared to SEQ ID NO: 150.

Table B2 and B3: MatGAT results for global similarity and identity over the full length of the polypeptide sequences.

TABLE B2

Global similarity amongst VPE polypeptides from dicotyledonous plants.

| | 1 | 2 | 3 | 4 | 5 | 6 | 7 | 8 | 9 | 10 | 11 | 12 |
|---|---|---|---|---|---|---|---|---|---|---|---|---|
| 1. SEQ ID NO: 150 | | 73.9 | 59 | 71.7 | 87.1 | 48.8 | 73.1 | 73.3 | 80 | 100 | 58.6 | 48.1 |
| 2. GM0604@contig24378 | 85 | | 57.9 | 78.8 | 75.4 | 49.5 | 75.2 | 75.2 | 73.3 | 73.9 | 57.3 | 49.9 |
| 3. GM0604@contig20207 | 73.3 | 70.1 | | 57.5 | 58.8 | 44.8 | 56 | 56 | 55.8 | 59 | 66.4 | 43.1 |
| 4. GM0604@contig13648 | 82.2 | 87.4 | 71.9 | | 74.1 | 50.4 | 74.3 | 73.9 | 70.5 | 71.7 | 58.9 | 50.5 |
| 5. BN0204@contig29409 | 91.9 | 86.7 | 71.3 | 83.6 | | 48.5 | 75.8 | 73.2 | 79.5 | 87.1 | 57.1 | 47.9 |
| 6. BN0204@contig26590 | 64.2 | 64.3 | 59.8 | 65.1 | 63.2 | | 50.1 | 49.2 | 49.7 | 48.8 | 47.5 | 76.3 |
| 7. Le_CAH56498.1_VPEg | 83.8 | 86.2 | 70.3 | 84.6 | 84.2 | 66 | | 81.1 | 73.2 | 73.1 | 57.5 | 50 |
| 8. Nt_BAC54827.1VPEg | 84.2 | 87.3 | 69.5 | 85.7 | 84.1 | 64.5 | 89 | | 71.1 | 73.3 | 55.8 | 49.9 |
| 9. AT2G25940 | 89.3 | 85.5 | 70.5 | 83 | 88.1 | 65.9 | 85.2 | 84.9 | | 80 | 57 | 48.6 |
| 10. AT4G32940 | 100 | 85 | 73.5 | 82.2 | 91.9 | 64.2 | 83.8 | 84.2 | 89.3 | | 58.6 | 48.1 |
| 11. AT1G62710 | 71.3 | 72 | 78.4 | 72.2 | 71.9 | 62.1 | 71 | 70.8 | 71.8 | 71.3 | | 47.1 |
| 12. AT3G20210 | 64.4 | 66.5 | 58.4 | 65.1 | 65.1 | 87.6 | 66.5 | 65.9 | 66.5 | 64.4 | 62.8 | |

TABLE B3

Global similarity amongst VPE polypeptides from monocotyledonous plants.

| | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| 1. SEQ ID NO 150 | | 67.7 | 41.7 | 46.6 | 68.5 | 55.6 | 67.5 | 67.1 | 67.3 | 66.3 | 67.1 | 49.3 | 57.6 | 54.1 |
| 2. ZM0404@contig11971 | 81.2 | | 48.1 | 45.7 | 84.8 | 54.7 | 85.4 | 83.4 | 92.2 | 97.3 | 83.4 | 50 | 57.3 | 60 |
| 3. TA0704@contig9701 | 55.9 | 58.8 | | 31 | 47.1 | 38.6 | 48 | 47.4 | 47.4 | 47.6 | 47.4 | 31 | 38.1 | 47.3 |
| 4. TA0704@contig15207 | 55.7 | 58 | 43.7 | | 47.9 | 50.9 | 48.5 | 45.3 | 46.5 | 46.5 | 45.3 | 48.1 | 55.9 | 41.7 |
| 5. TA0704@contig14121 | 81.6 | 92.3 | 58.6 | 58.4 | | 53.2 | 94.1 | 83.4 | 83.5 | 84.6 | 83.4 | 49.5 | 55.9 | 58.2 |
| 6. TA0704@contig11093 | 70 | 70.6 | 53.6 | 60.5 | 70 | | 55 | 54.9 | 55.6 | 54.8 | 54.9 | 56.9 | 70.6 | 46.8 |
| 7. HV0704@contig6924 | 79.6 | 92.4 | 57.9 | 58.3 | 95.7 | 70.2 | | 82.4 | 83 | 84.8 | 82.4 | 49.8 | 56.5 | 57.6 |
| 8. OS_BAB85400_VPEg | 80.8 | 91 | 57.5 | 56.3 | 89 | 70.3 | 87.8 | | 81 | 83 | 100 | 49.1 | 59.2 | 57.5 |
| 9. So_ABF00019.1_VPE | 81.6 | 96.3 | 59.8 | 57.8 | 91.7 | 71.1 | 91 | 88.8 | | 92 | 81 | 49.4 | 57.9 | 58.4 |
| 10. ZM_CAC18100.1VPEg | 80.2 | 97.7 | 58.1 | 58.1 | 91.9 | 70.4 | 91.8 | 90 | 95.7 | | 83 | 49.7 | 57.1 | 59.3 |
| 11. Os01g0559600 | 80.8 | 91 | 57.5 | 56.3 | 89 | 70.3 | 87.8 | 100 | 88.8 | 90 | | 49.1 | 59.2 | 57.5 |
| 12. Os02g0644000 | 59.3 | 61.3 | 44.3 | 64.7 | 60.6 | 66.4 | 60.5 | 59.9 | 61.9 | 61.2 | 59.9 | | 61 | 43.7 |
| 13. Os04g0537900 | 71.2 | 72.8 | 52.9 | 63.8 | 72.2 | 82.5 | 71.2 | 72.9 | 73 | 72.4 | 72.9 | 69.8 | | 48.6 |
| 14. Os05g0593900 | 70.2 | 73.5 | 58.9 | 55.7 | 71.8 | 63.4 | 71.5 | 71.1 | 73.2 | 73.4 | 71.1 | 57 | 65.2 | |

Example 15

Identification of Domains Comprised in VPEs

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Interpro is hosted at the European Bioinformatics Institute in the United Kingdom.

The results of the InterPro scan of the polypeptide sequence as represented by SEQ ID NO: 150 are presented in Table B4.

TABLE B4

InterPro scan results of the polypeptide sequence as represented by SEQ ID NO: 150

| Database | Accession number | Accession name | e-value | aa coordinates in SEQ ID 150 for the domain |
|---|---|---|---|---|
| Pfam | PF01650 | Peptidase_C13 | 1.0E125 | 54-478 |

Example 16

Topology Prediction for VPEs

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cut-off sets (none, predefined set of cut-offs, or user-specified set of cut-offs), and the calculation of prediction of cleavage sites (yes or no).

The results of TargetP 1.1 analysis of the polypeptide sequence as represented by SEQ ID NO: 150 are presented Table B5. The "plant" organism group was selected, no cut-offs defined, and the predicted length of the transit peptide requested. The subcellular localization of the polypeptide sequence as represented by SEQ ID NO: 150 is the secretory pathway and the predicted length of the transit peptide is of 20 amino acids starting from the N-terminus (not as reliable as the prediction of the subcellular localization itself, may vary in length of a few amino acids). Highest score was for the secretory pathway signal indicating that there is a high probability that the VPEg protein is targeted to the secretory pathway.

TABLE B5

TargetP 1.1 analysis of the polypeptide sequence as represented by SEQ ID NO: 150

| | |
|---|---|
| Length (AA) | 494 |
| Mitochondrial transit peptide | 0.108 |
| Secretory pathway signal peptide | 0.966 |
| Other subcellular targeting | 0.006 |
| Predicted Location | Secretory pathway |
| Reliability class | 2 |
| Predicted transit peptide length | 20 |

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

TMHMM, hosted on the server of the Technical University of Denmark

Example 17

Assay for VPEs

The peptidase activity of VPEg is assayed by incubating the protein with the substrate proteins and determining the cleaved products as previously described (Rojo et al. 2004 Current Biology 14, 1897-1906; Haraiwa et al. 1999, FEBS 447:213-216; Hatsugai et al. 2004, Science 6: Vol. 305. no. 5685, pp. 855-858). The synthetic decapeptide Ser-Glu-Ser-Glu-Asn-Gly-Leu-Glu-Glu-Thr as described by Haraiwa et al. 1999, the carboxypeptidase Y and the VPEg itself are chosen as substrates in the cleavage reaction. Cleaved products are separated by capillary electrophoresis and detected by absorbance at 200 nm or by western blot.

Example 18

Cloning of Nucleic Acid Sequence as Represented by SEQ ID NO: 149

Unless otherwise stated, recombinant DNA techniques were performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Arabidopsis thaliana* VPEg gene was amplified by PCR using as template an *Arabidopsis thaliana* seedling cDNA library (Invitrogen, Paisley, UK). Primers SEQ ID NO: 206; sense, 5'-ggggacaagtttgtacaaaaaagcag-gcttaaacaatggccacaacgatgaca-3') and SEQ ID NO: 207; reverse, complementary, 5'-ggggaccactttgtacaa-gaaagctgggtcggtttagggtttctatgcac-3'), which include the AttB sites for Gateway recombination, were used for PCR amplification. PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone", pVPEg. Plasmid pDONR201 was purchased from Invitrogen, as part of the Gateway® technology.

Example 19

Expression Vector Construction Using the Nucleic Acid Sequence as Represented by SEQ ID NO: 149

The entry clone pVPEg was subsequently used in an LR reaction with a destination vector used for *Oryza sativa* transformation. This vector contains as functional elements within the T-DNA borders: a plant selectable marker; a screenable marker expression cassette; and a Gateway cassette intended for LR in vivo recombination with the nucleic acid sequence of interest already cloned in the entry clone. A rice WSI18 promoter (SEQ ID NO: 205) for seed specific expression was located upstream of this Gateway cassette.

Figure 7:
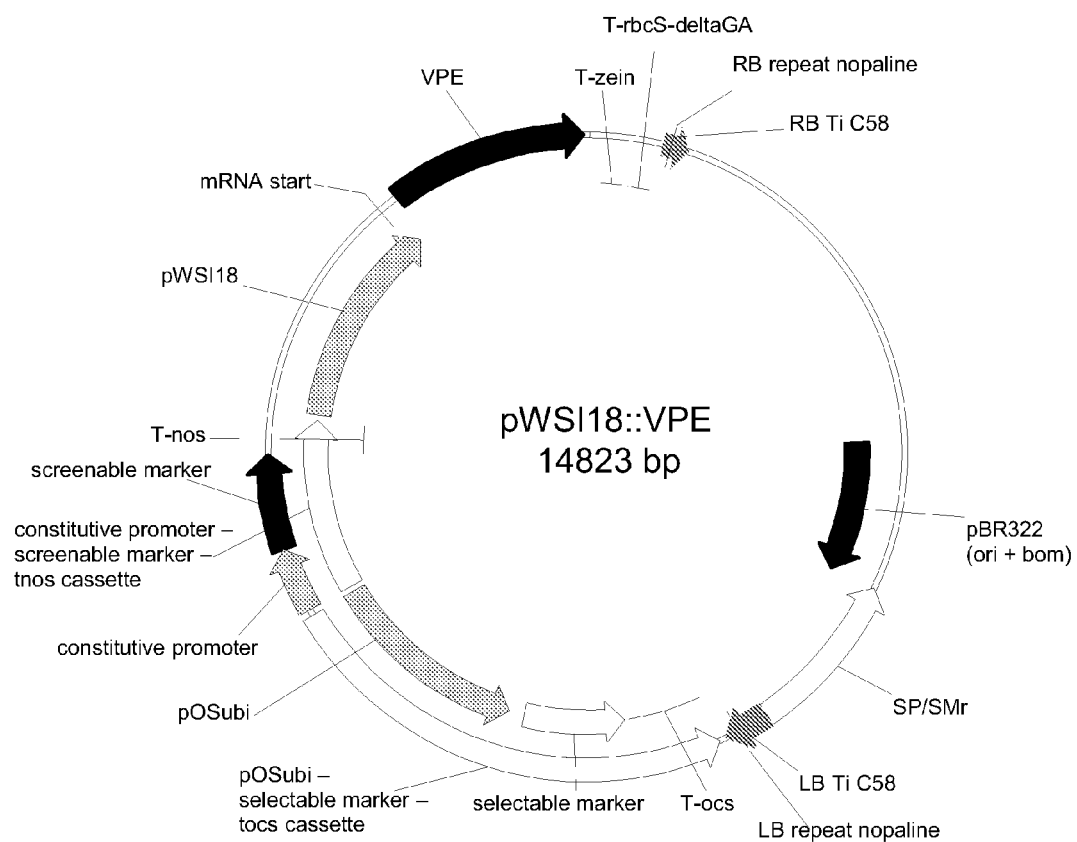
FIG. 7 shows the binary vector for increased expression in *Oryza sativa* of an *Arabidopsis thaliana* VPE-encoding nucleic acid under the control of the rice-WSI18 gene promoter.
Figure 9:
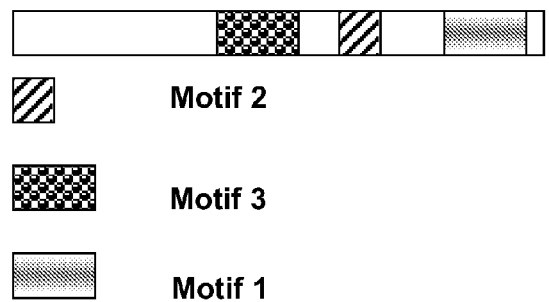
FIG. 9 shows the domain structure and their respective positions in a SAP-like polypeptide, with Motif 1 being the SAP-like domain.

After the LR recombination step, the resulting expression vector pWSI18::VPE (FIG. 7) was transformed into *Agrobacterium* strain LBA4044 according to methods well known in the art.

Example 20

Plant Transformation

See Example 9 above for details of plant transformation.

Example 21

Phenotypic Evaluation Procedure

For details see Example 10 above.

Example 22

Examples of Abiotic Stress Screens

Drought Screen

Plants from a selected number of events are grown in potting soil under normal conditions until they approached the heading stage. They are then transferred to a "dry" section where irrigation is withheld. Humidity probes are inserted in randomly chosen pots to monitor the soil water content (SWC). When SWC go below certain thresholds, the plants are automatically re-watered continuously until a normal level is reached again. The plants are then re-transferred to normal conditions. The rest of the cultivation (plant maturation, seed harvest) is the same as for plants not grown under abiotic stress conditions. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants were harvested. Growth and yield parameters are recorded as detailed for growth under normal conditions.

Reduced Nutrient (Nitrogen) Availability Screen

Plants from six events (T2 seeds) were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters were recorded as detailed for growth under normal conditions (see Example 10).

Example 23

Results of the Phenotypic Evaluation of the Transgenic Plants

The results of the evaluation of transgenic rice plants expressing the VPE are presented in Tables B6-B9 (unless otherwise indicated, the results are obtained on plants grown under non-stress conditions). The percentage difference between the transgenics and the corresponding nullizygotes is also shown, with a P value from the F test below 0.05.

Total seed yield, number of filled seeds, seed fill rate and harvest index are significantly increased, compared to the control plants (in this case, the nullizygotes).

TABLE B6

Results of the evaluation of transgenic rice plants pWSI::VPE.

| Trait | % Increase |
| --- | --- |
| Total seed yield | 18 |
| Number of filled seeds | 28 |
| Fill rate | 18 |
| Harvest index | 17 |
| Root shoot index | 7 |

The results of the evaluation of transgenic rice plants grown under reduced nitrogen availability and expressing pWSI::VPE according to Example 19 are given in Table B7 below.

TABLE B7

Results of the evaluation of VPE::pwsi18 under reduced nitrogen availability

| Parameter | % Diff |
| --- | --- |
| Aboveground biomass | 16.1 |
| Emergence Vigour | 43.2 |
| Total weight seeds | 20.7 |
| No. filled seeds | 18.8 |
| Harvest index | 12.3 |

The results of the evaluation of transgenic rice plants grown under reduced nitrogen availability and expressing a VPE construct according to Example 19 except where the wsi18 promoter is replaced with a constitutive GOS2 promoter are given in Table B8 below. This same construct with the GOS2 promoter gave the results shown in Table B9 under non-stress conditions.

TABLE B8

Results of the evaluation of VPE::pGOS2 under reduced nitrogen availability

| Parameter | % Diff |
| --- | --- |
| Aboveground biomass | 5 |
| Root Biomass | 6 |
| Emergence Vigour | 25 |
| No. flowers per panicle | 7 |

TABLE B9

Results of the evaluation of VPE::pGOS2 under non-stress conditions

| Parameter | % Diff |
|---|---|
| Aboveground biomass | 5 |
| Root biomass | 5 |
| Total weight seeds | 8.9 |
| No. filled seed | 8.5 |
| No. flower per panicle | 6.9 |
| No. total seeds | 8.3 | parisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

In addition to the publicly available nucleic acid sequences available at NCBI, proprietary sequence databases are also searched following the same procedure as described herein above.

Table C1 provides a list of nucleic acid and protein sequences related to the nucleic acid sequence as represented by SEQ ID NO: 210 and the protein sequence represented by SEQ ID NO: 211.

TABLE C1

Nucleic acid sequences related to the SAP-encoding nucleic acid sequence of SEQ ID NO: 210, and the corresponding deduced polypeptides.

| Name | Source organism | Nucleic acid SEQ ID NO: | Poly-peptide SEQ ID NO: | Status |
|---|---|---|---|---|
| SAP_Like | Oryza sativa | 210 | 211 | Full length |
| GM0604@contig350. | Glycine maxima | 212 | 213 | Full length |
| TAG01@SIN_31b-CS. | Tagetes spp | 214 | 215 | Partial |
| BN0204@contig380.. | Brassica napa | 216 | 217 | Full length |
| HV0704@contig195 | Hordeum vulgare | 218 | 219 | Full length |
| TA0704@54203527. | Triticum aestivum | 220 | 221 | Partial |
| TA0704@54582401 | Triticum aestivum | 222 | 223 | Partial |
| TA0704@gi_205507 | Triticum aestivum | 224 | 225 | Partial |
| ZM0404@contig115 | Zea mays | 226 | 227 | Partial |
| ZM0404@contig319. | Zea mays | 228 | 229 | Partial |
| OS_AAK92634.1 | Oryza sativa | 230 | 231 | Full length |
| OS_Os01g0205300 | Oryza sativa | 232 | 233 | Full length |
| Mb_ABF70123.1 | Musa balbisiana | 234 | 235 | Full length |
| AT1G06190 | Arabidopsis thaliana | 236 | 237 | Full length |
| AT4g18740 | Arabidopsis thaliana | 238 | 239 | Full length |

Part III. SAP

Example 24

Identification of Sequences Related to Sap Sequences According to SEQ ID NO: 210 and SEQ ID NO: 211

Sequences (full length cDNA, ESTs or genomic) related to SEQ ID NO: 210 and/or protein sequences related to SEQ ID NO: 211 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. The polypeptide encoded by SEQ ID NO: 210 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, com- Example 25

Alignment of SAP-Like Polypeptide Sequences

Figure 10:
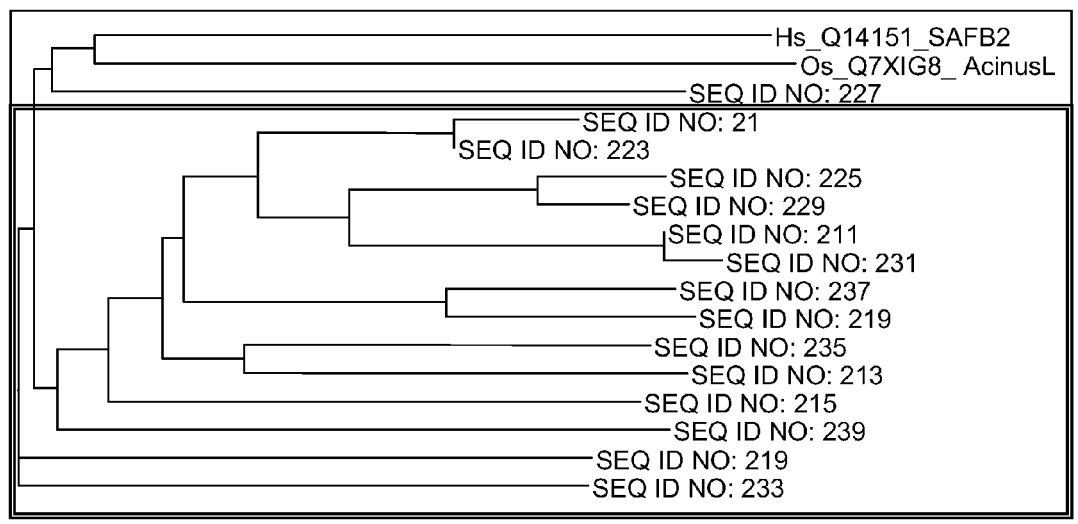
FIG. 10A shows a phylogenetic tree and sequence alignment of SAP and SAP-like polypeptides. The Glade with SAP polypeptides is boxed in a single line; the double line boxes the clades with SAP-like polypeptides.
FIG. 10B shows an alignment of SAP-like polypeptides. The consensus sequence shown in FIG. 10B corresponds to SEQ ID NO: 361.

Alignment of polypeptide sequences was performed using the AlignX programme from the Vector NTI (Invitrogen) which is based on the popular Clustal algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0.1 and the selected weight matrix is Blosum 62 (if polypeptides are aligned). Results in FIG. 10 show that SAP-like proteins share regions of high sequence conservation. Motif1, Motif2 and Motif3 represent the regions with highest sequence homology.

Figures 10, 11:
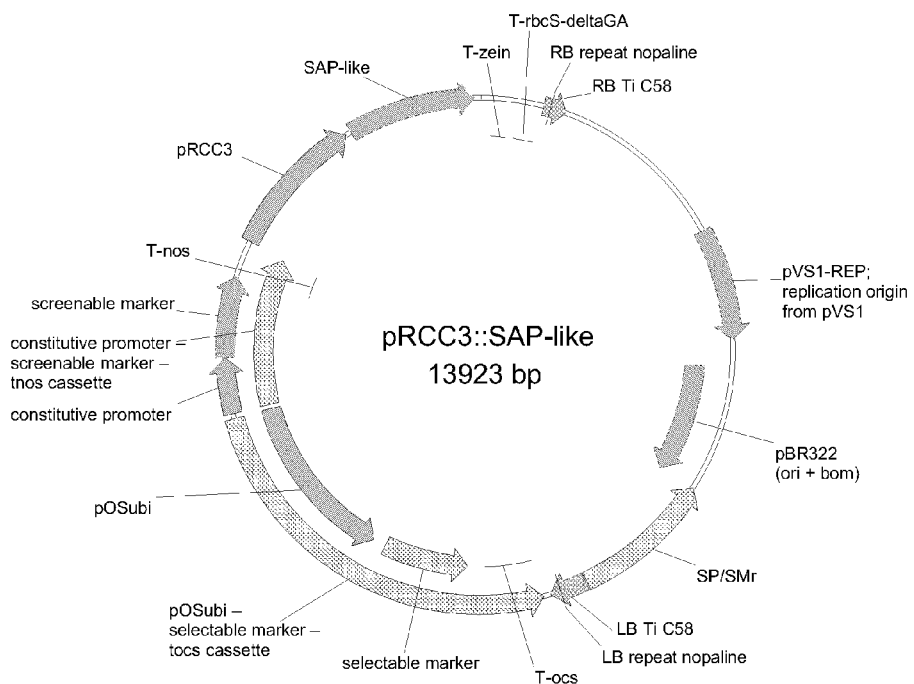
FIG. 11 shows the binary vector for increased expression in *Oryza sativa* of an *Oryza sativa* SAP-like protein-encoding nucleic acid under the control of the rice RCC3 promoter (pRCC3).
Figure 13:
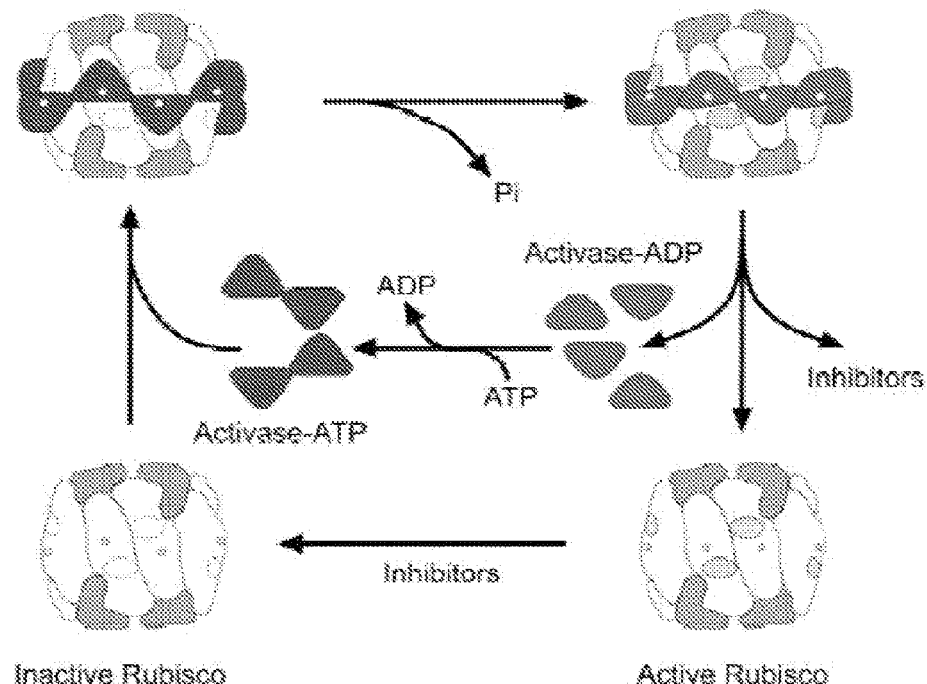
FIG. 13 shows a model for RCA activation of RuBisCO. The sugar phosphate inhibitors bind to the active site of the RuBisCo large subunits, thereby closing them. RCA via ATP hydrolysis will oligomerise and bind to Rubisco to form a supercomplex consisting of the large and small RuBisCo subunits encircled by the 16 RCA subunits. This binding is responsible for conformational changes that will lead to a release of the individual RCA subunits, a release of the inhibitors, and an opening of the RuBisCo active sites (for more detailed explanations, see in Portis (2003) Photosynthesis Research 75:11-27).
Figure 14:
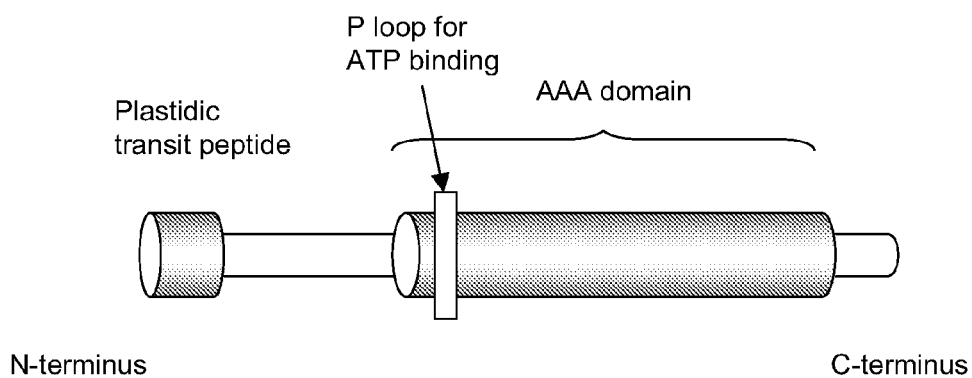
FIG. 14 represents a drawing of the important features comprised in an RCA polypeptide, i.e., a transit peptide for plastidic targeting, an AAA domain, and a P loop triphosphate-binding loop consensus sequence G(G/R)KG(Q/E)GK(S/T), for nucleotide binding, corresponding to Motif1 as represented by SEQ ID NO: 312.

A phylogenetic tree of SAP and SAP-like polypeptides was constructed using a neighbour-joining clustering algorithm as provided in the AlignX programme from the Vector NTI (Invitrogen). FIG. 11 shows how SAP-like polypeptide cluster with SEQ ID NO: 211 rather than with SAP proteins such as SAFB2 polypeptide.

Example 26

Calculation of Global Percentage Identity Between SAP-Like Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29.

MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table C2 for the global similarity and identity over the full length of the polypeptide sequences. Percentage identity is given above the diagonal and percentage similarity is given below the diagonal.

The percentage identity between the SAP-like polypeptide sequences start at 13% amino acid identity compared to SEQ ID NO: 211.

TABLE C2

MatGAT results for global similarity and identity over the full length of the polypeptide sequences.

|  | 1 | 2 | 3 | 4 | 5 | 6 | 7 | 8 | 9 |
|---|---|---|---|---|---|---|---|---|---|
| 1. SEQ_ID_NO: 211 |  | 35.3 | 21.6 | 15 | 57.8 | 14.7 | 32.3 | 34.9 | 20.1 |
| 2. SEQ_ID_NO: 213 | 55.2 |  | 23 | 14.7 | 22.5 | 15 | 30.6 | 40.2 | 22.3 |
| 3. SEQ_ID_NO: 217 | 34.1 | 37 |  | 19.7 | 13.4 | 18 | 27.2 | 43.1 | 20 |
| 4. SEQ_ID_NO: 219 | 24.5 | 23.9 | 30.6 |  | 9.6 | 30.4 | 19.7 | 14.4 | 19.9 |
| 5. SEQ_ID_NO: 231 | 58.5 | 35.1 | 21 | 15.5 |  | 8.5 | 18.9 | 22.6 | 13.2 |
| 6. SEQ_ID_NO: 233 | 22.1 | 23.9 | 30.2 | 40.6 | 13.6 |  | 19.3 | 12 | 19.5 |
| 7. SEQ_ID_NO: 235 | 46.9 | 42.9 | 47.3 | 31.8 | 27.8 | 29.5 |  | 28.9 | 21.3 |
| 8. SEQ_ID_NO: 237 | 52.9 | 53.6 | 52.1 | 23.4 | 34.3 | 19.7 | 40.4 |  | 19.9 |
| 9. SEQ_ID_NO: 239 | 35.2 | 35.7 | 36.5 | 33.1 | 22.4 | 31.5 | 40.3 | 32.2 |  |

Example 27

Identification of Domains Comprised in SEQ ID NO: 211

Conserved domains in the sequence of SAP-like polypeptide SEQ ID NO: 211 were identified by searching for similarity with protein domains and protein families present in the Pfam database. Table C3 summarizes the domains found. The beginning and end of the conserved domain in SEQ ID NO: 211 is indicated by the corresponding amino acid coordinate.

Example 28

Activity Assay Related to SEQ ID NO:211

DNA binding activity of the rice SAP-like protein in SEQ ID NO: 211 is determined in an in vitro assay as previously reported by Chen et al. 2003. SEQ ID NO: 211 is overexpressed in *E. coli* cells and purified. The purified protein is incubated with substrate DNA. A DNA fragment of 31 by (base pairs) derived from the rice Waxy gene is chosen as DNA substrate. The Protein-DNA complexes can be identified by electrophoresis in gel retardation assays.

Example 29

Cloning of Nucleic Acid Sequence as Represented by SEQ ID NO: 210

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Oryza sativa* SAP-like gene was amplified by PCR using as template an *Oryza sativa* seedling cDNA library (Invitrogen, Paisley, UK). Primers prm08655 (SEQ ID NO: 247; sense, 5'-ggggacaagtttgtacaaaaaagcag-gcttaaacaatggccacaacgatgacac-3') and prm08656 (SEQ ID NO: 248; reverse, complementary, 5'-ggggaccactttgtaca agaaagctgggtcggtttagggtttctatgcac-3'), which include the

TABLE C3

Pfam scan results of the polypeptide sequence as represented by SEQ ID NO: 211

| Database/ accession number | Seq from | aa Coordinate Begin | aa Coordinate End | Score | E-value | Alignment | Description | Accession description |
|---|---|---|---|---|---|---|---|---|
| Pfam/ DUF1098 | DUF1098 | 212 | 250 | 39 | 9.6 | 0.037 | local | Protein of unknown function (DUF1098) |
| Pfam/ PF07498 | Rho_N | 338 | 371 | 35 | 37.7 | 4.70E−10 | local | Rho termination factor, N-terminal domain |
| Pfam/ PF02037 | SAP | 339 | 355 | 17 | 12.5 | 0.02 | local | SAP domain |
| Pfam/ PF02037 | SAP | 359 | 372 | 14 | 1.6 | 22 | local | SAP domain |

AttB sites for Gateway recombination, were used for PCR amplification. PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombines in vivo with the pDONR201 plasmid to produce, according to the Gateway terminology, an "entry clone". Plasmid pDONR201 was purchased from Invitrogen, as part of the Gateway® technology.

Example 30

Expression Vector Construction Using the Nucleic Acid Sequence as Represented by SEQ ID NO: 210

The entry clone containing SEQ ID NO: 210, pSAP-like, was subsequently used in an LR reaction with pRCC3, a destination vector used for *Oryza sativa* transformation. This vector contains as functional elements within the T-DNA borders: a plant selectable marker; a screenable marker expression cassette; and a Gateway cassette intended for LR in vivo recombination with the nucleic acid sequence of interest already cloned in the entry clone. A rice RCC3 promoter (SEQ ID NO: 246) for root specific expression was located upstream of this Gateway cassette.

After the LR recombination step, the resulting expression vector pRCC3::SAP-like (FIG. 11) was transformed into *Agrobacterium* strain LBA4044 according to methods well known in the art.

Example 31

Plant Transformation

See Example 9 above

Example 32

Phenotypic Evaluation Procedure

For details see Examples 10 and Example 22

Example 33

Results of the Phenotypic Evaluation of the Transgenic Plants

The results of the evaluation of transgenic rice plants expressing the nucleic acid sequence useful in performing the methods of the invention are presented in Table C4 to C9. The percentage difference between the transgenics and the corresponding nullizygotes is also shown, with a P value from the F test below 0.1.

Total seed yield, number of filled seeds, seed fill rate, harvest index, the number of flowers per panicle, the thousand kernel weight, the plant height and the emergence vigour are significantly increased in the transgenic plants expressing the nucleic acid sequence useful in performing the methods of the invention, compared to the control plants (in this case, the nullizygotes).

TABLE C4

Results of the evaluation of rice plants transformed with pRCC3::SAP-like vector.

| Trait | % Increase in transgenic versus control plants |
|---|---|
| Total seed yield | 29 |
| Number of filled seeds | 26 |
| Fill rate | 19 |
| Harvest index | 27 |
| Number flower per panicle | 5 |
| TKW | 3 |
| Plant Height | 7 |
| Emergence vigour | 28 |

The SAP-like nucleic acid in these transgenic plants is expressed in the roots under the control of the rice RCC3 promoter.

TABLE C5

Results of the evaluation of rice plants transformed with pGOS2::SAP-like vector.

| Trait | % Increase in transgenic versus control plants |
|---|---|
| Total seed yield | 7 |

The SAP-like nucleic acid in these transgenic plants is expressed constitutively under the control of the rice GOS2 promoter (de Pater et al, Plant J Nov; 2(6): 837-44, 1992, WO 2004/065596).

TABLE C6

Results of the evaluation of rice plants transformed with p(PcR)::SAP-like vector.

| Trait | % Increase in transgenic versus control plants |
|---|---|
| Total seed yield | 12 |

The SAP-like nucleic acid in these transgenic plants is expressed constitutively under the control of the rice putative protochlorophyllide reductase promoter (WO 2004/070039).

TABLE C7

Results of the evaluation of rice plants tested under drought conditions as described in Example 22 and transformed a vector pRCC3::SAP-like.

| Parameter | % Diff |
|---|---|
| Total seed weight | 14.2 |
| No. filled seeds | 15.5 |
| Fill rate | 22 |
| Harvest index | 22.6 |

TABLE C8

Results of the evaluation of rice plants tested under reduced nitrogen availability as described in Example 22 and transformed with a vector pRCC3::SAP-like.

| Parameter | % Diff |
|---|---|
| Aboveground biomass | 9.1 |
| Ermergence vigour | 20.1 |

TABLE C9

Results of the evaluation of rice plants under
drought conditions as described in Example 22 and
transformed with a p(PcR)::SAP-like vector.

| Trait | % Increase in transgenic versus control plants |
|---|---|
| Seed filling | 14 |

The SAP-like nucleic acid in these transgenic plants is expressed constitutively under the control of the rice putative protochlorophyllide reductase promoter (WO 2004/070039).

Part IV. RCA

Example 34

Identification of Sequences Related to RCA Sequences According to SEQ ID NO: 250 and SEQ ID NO: 251

Sequences (full length cDNA, ESTs or genomic) related to SEQ ID NO: 250 and/or protein sequences related to SEQ ID NO: 251 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. The polypeptide encoded by SEQ ID NO: 250 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

In addition to the publicly available nucleic acid sequences available at NCBI, proprietary sequence databases are also searched following the same procedure as described herein above.

Table D1 provides a list of nucleic acid and polypeptide sequences related to the nucleic acid sequence as represented by SEQ ID NO: 250 and the protein sequence represented by SEQ ID NO: 251. Such nucleic acid sequences encode naturally occurring beta (short form, or SF) RCA polypeptides, or from alpha (long form, or LF)) RCA polypeptides that have to be truncated or mutated in the C-terminal extension to prevent redox regulation.

TABLE D1

Nucleic acid sequences related to the nucleic acid sequence (SEQ ID NO: 250)
useful in the methods of the present invention, and the corresponding deduced polypeptides.

| Name | Source organism | Nucleic acid SEQ ID NO: | Polypeptide SEQ ID NO: | Database accession number | Status |
|---|---|---|---|---|---|
| Chlre_RCA | Chlamydomonas reinhardtii | 250 | 251 | AY461703 | Full length |
| Chlli_RCA | Chlorococcum littorale | 252 | 253 | Y10657 | Full length |
| Ostta_RCA | Ostreococcus tauri strain OTTH0595 | 254 | 255 | CR954204 | Full length |
| Arath_RCA SF | Arabidopsis thaliana | 256 | 257 | NM_179989 AT2G39730.2 | Full length |
| Arath_RCA LF | Arabidopsis thaliana | 258 | 259 | X14212 | Full length |
| Aceru_RCA SF | Acer rubrum | 260 | 261 | DQ915973 | Full length |
| Aceru_RCA LF | Acer rubrum | 262 | 263 | DQ915974 | Full length |
| Chequ_RCA SF | Chenopodium quinoa | 264 | 265 | AY117142 | Full length |
| Desan_RCA SF | Deschampsia antartica | 266 | 267 | AY312574 | Full length |
| Desan_RCA LF | Deschampsia antartica | 268 | 269 | AY312573 | Full length |
| Glyma_RCA LF | Glycine max | 270 | 271 | | Full length |
| Goshi_RCA SF | Gossypium hirsutum | 272 | 273 | AF329934 | Full length |
| Horvu_RCA SF | Hordeum vulgare | 274 | 275 | M55447.1_BLYRCAA2 | Full length |
| Horvu_RCA SFII | Hordeum vulgare | 276 | 277 | M55448.1_BLYRCAB | Full length |
| Lartr_RCA SF | Larrea tridentata | 278 | 279 | AY312576 | Full length |
| Lycpe_RCA LF | Lycopersicon pennellii | 280 | 281 | AF037361 | Full length |
| Maldo_RCA SF | Malus domestica | 282 | 283 | Z21794 | Full length |
| Nicta_RCA SF | Nicotiana tabacum | 284 | 285 | U35111 | Full length |
| Orysa_RCA LF | Oryza sativa | 286 | 287 | AB034698 | Full length |
| Orysa_RCA SF | Oryza sativa | 288 | 289 | AB034748 | Full length |
| Phavu_RCA SF | Phaseolus vulgaris | 290 | 291 | AF041068 | Full length |
| Triae_RCA SF | Triticum aestivum | 292 | 293 | AF251264 | Full length |
| Zeama_RCA SF | Zea mays | 294 | 295 | Contig of EE034185.1 BI675068 | Full length |
| Datgl_RCA | Datisca glomerata | 296 | 297 | AF047352 | Partial |
| Zanae_RCA Partial 3' | Zantedeschia aethiopica | 298 | 299 | AF338240 | Partial |
| Anasp_RCA | Anabaena variabilis ATCC 29413 | 300 | 301 | CP000117.1 | Full length |
| Nossp_RCA | Nostoc sp. PCC 7120 | 302 | 303 | BA000019.2 | Full length |
| Synco_RCA | Synechococcus sp. JA-3-3Ab | 304 | 305 | CP000239 | Full length |

TABLE D1-continued

Nucleic acid sequences related to the nucleic acid sequence (SEQ ID NO: 250)
useful in the methods of the present invention, and the corresponding deduced polypeptides.

| Name | Source organism | Nucleic acid SEQ ID NO: | Polypeptide SEQ ID NO: | Database accession number | Status |
|---|---|---|---|---|---|
| Flabi_RCA | Flaveria bidentis | 313 | 314 | EU202926.1 | Full length |
| Ostlu_RCA | Ostreococcus lucimarinus | 315 | 316 | jgi_Ost99013_31184_eugene.0400010260 | Full length |
| Vigra_RCA | Vigna radiata | 317 | 318 | AF126870 | Full length |
| Volva_RCA | Volvox carteri | 319 | 320 | jgi_Volca1_105291_est Ext_fgenesh4_pg.C_260106 | Full length |

In some instances, related sequences have tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute, for example for *Ostreococcus lucimarinus* and *Volvox carteri*.

Example 35

Alignment of Relevant Polypeptide Sequences

AlignX from the Vector NTI (Invitrogen) is based on the popular Clustal algorithm of progressive alignment (Thompson et al. (1997) Nucleic Acids Res 25:4876-4882; Chenna et al. (2003). Nucleic Acids Res 31:3497-3500). A phylogenetic tree can be constructed using a neighbour-joining clustering algorithm. Default values are for the gap open penalty of 10, for the gap extension penalty of 0.1 and the selected weight matrix is Blosum 62 (if polypeptides are aligned).

Figure 15:
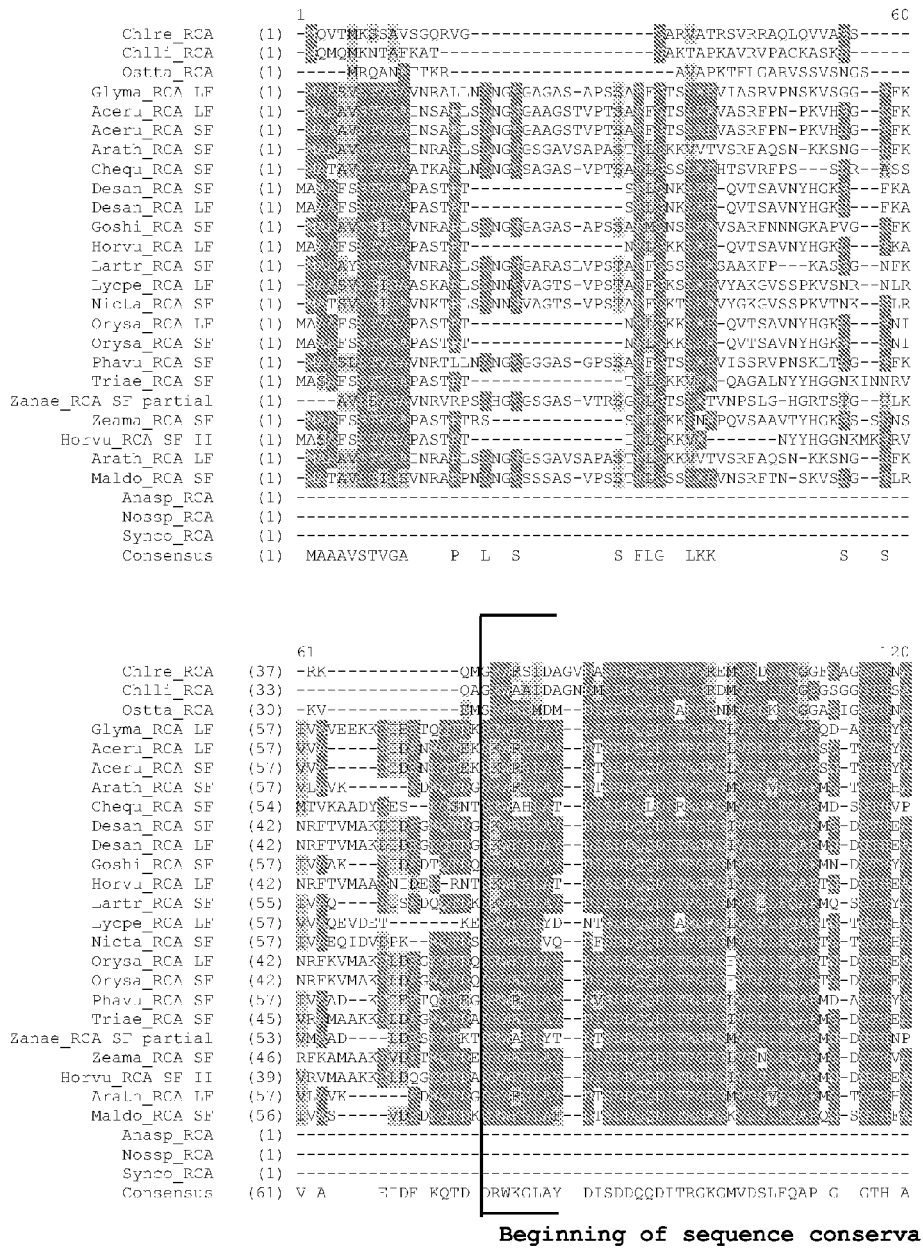
FIG. 15 shows an alignment of RCA polypeptides. The sequences were aligned using AlignX program from Vector NTI suite (InforMax, Bethesda, Md.). Multiple alignment was done with a gap opening penalty of 10 and a gap extension of 0.01. The beginning of sequence conservation between eukaryotic RCA polypeptides is delineated with a bracket (the amino acid sequence N-terminal upstream of this bracket is considered as comprising the transit peptide for plastidic subcellular targeting), as are the beginning and the end of the AAA domain. The P loop is boxed, and corresponds to Motif 1 as represented by SEQ ID NO: 312. The beginning of the C-terminal extension is also marked with a bracket. The sequences shown are: Chlre_RCA (SEQ ID NO: 251), Chlli_RCA (SEQ ID NO: 253), Ostta_RCA (SEQ ID NO: 255), Glyma_RCA LF (SEQ ID NO: 271), Aceru_RCA LF (SEQ ID NO: 263), Aceru_RCA SF (SEQ ID NO: 261), Arath_RCA SF (SEQ ID NO: 257), Chequ_RCA SF (SEQ ID NO: 265), Desan_RCA SF (SEQ ID NO: 267), Desan_RCA LF (SEQ ID NO: 269), Goshi_RCA SF (SEQ ID NO: 273), Horvu_RCA LF (SEQ ID NO: 275), Lartr_RCA SF (SEQ ID NO: 279), Lycpe_RCA LF (SEQ ID NO: 281), Nicta_RCA SF (SEQ ID NO: 285), Orysa_RCA LF (SEQ ID NO: 287), Orysa_RCA SF (SEQ ID NO: 289), Phavu_RCA SF (SEQ ID NO: 291), Triae_RCA SF (SEQ ID NO: 293), Zanae_RCA SF partial (SEQ ID NO: 299), Zeama_RCA SF (SEQ ID NO: 295), Horvu_RCA SF II (SEQ ID NO: 277), Arath_RCA LF (SEQ ID NO: 259), Maldo_RCA SF (SEQ ID NO: 283), Anasp_RCA (SEQ ID NO: 301), Nossp_RCA (SEQ ID NO: 303), Synco_RCA (SEQ ID NO: 305), consensus (SEQ ID NO: 362).
Figure 15:
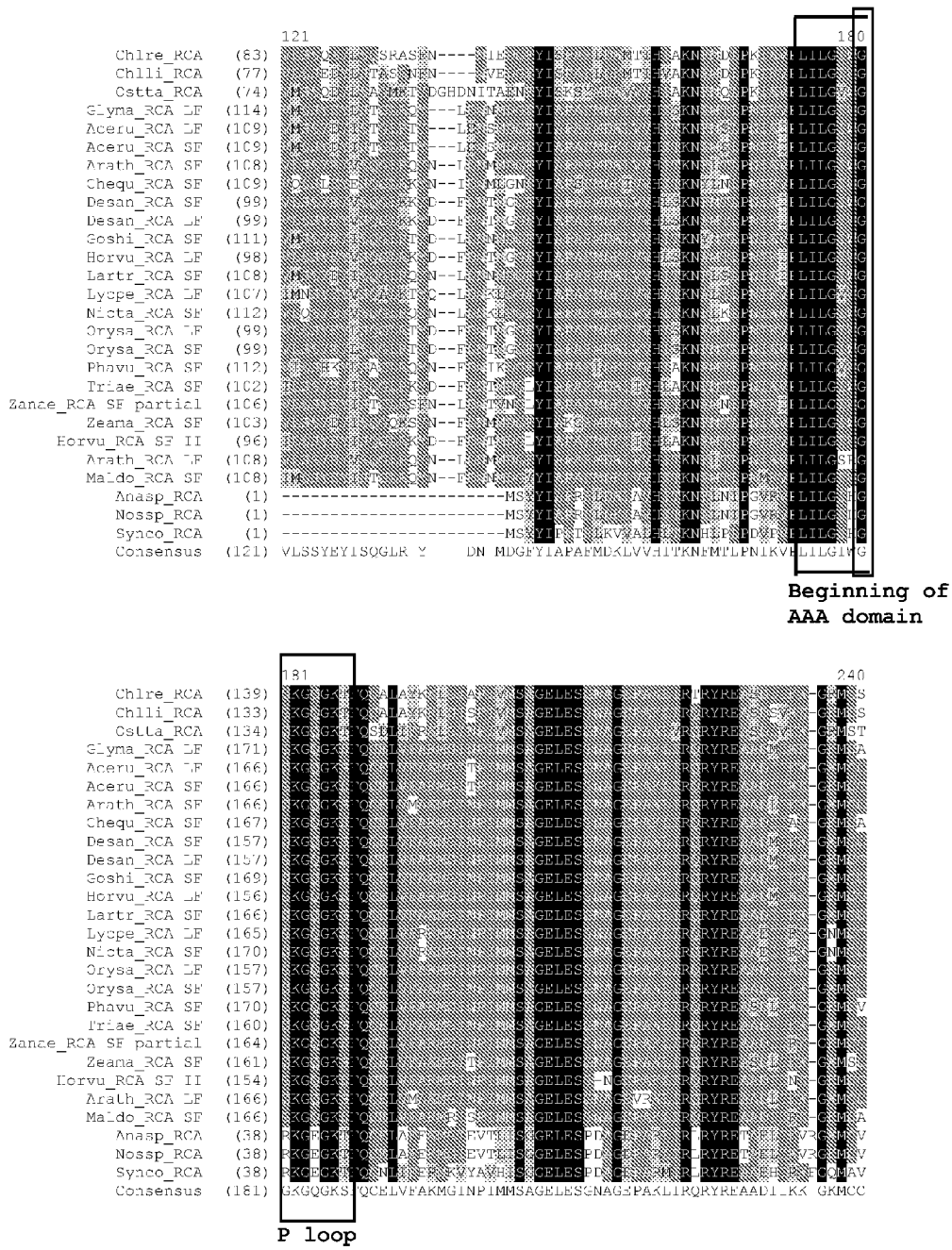

The result of the multiple sequence alignment using polypeptides relevant in identifying the ones useful in performing the methods of the invention is shown in FIG. 15. The sequences were aligned using AlignX program from Vector NTI suite (InforMax, Bethesda, Md.). Multiple alignment was done with a gap opening penalty of 10 and a gap extension of 0.01. The beginning of sequence conservation between eukaryotic RCA polypeptides is delineated with a bracket (the amino acid sequence N-terminal upstream of this bracket is considered as comprising the transit peptide for plastidic subcellular targeting), as are the beginning and the end of the AAA domain. The P loop is boxed, and corresponds to Motif 1 as represented by SEQ ID NO: 312. The beginning of the C-terminal extension is also marker with a bracket. Within this C-terminal extension, the Cys residues involved in redox regulation are marked in bold in the alpha (long form or LF) RCA polypeptides. These are preferred targets for site-directed mutagenesis (into Ala residues, for example) to prevent the formation of disulfide bridges, and thus, redox regulation.

Example 36

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table D2 for the global similarity and identity over the full length of the polypeptide sequences (excluding the partial polypeptide sequences). Percentage identity is given above the diagonal and percentage similarity is given below the diagonal.

The percentage identity between the polypeptide sequences useful in performing the methods of the invention can be as low as 50% amino acid identity compared to SEQ ID NO: 251.

TABLE D2

MatGAT results for global similarity and identity over the full length of the RCA polypeptide sequences.

| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| 1. Aceru_RCA\LS | | 92 | 77 | 75 | 55 | 72 | 56 | 66 | 77 | 72 | 85 | 79 | 70 | 71 | 80 | 73 | 78 | 73 | 78 | 73 | 53 | 75 | 71 | 75 | 70 |
| 2. Aceru_RCA\SF | 92 | | 72 | 79 | 59 | 78 | 60 | 72 | 71 | 78 | 79 | 85 | 76 | 77 | 86 | 75 | 85 | 79 | 72 | 78 | 56 | 81 | 77 | 81 | 76 |
| 3. Arath_RCA\LF | 86 | 80 | | 91 | 54 | 70 | 55 | 60 | 75 | 69 | 78 | 74 | 68 | 69 | 73 | 70 | 72 | 71 | 77 | 71 | 54 | 69 | 69 | 70 | 67 |
| 4. Arath_RCA\SF | 84 | 88 | 91 | | 59 | 76 | 59 | 66 | 72 | 76 | 75 | 81 | 74 | 76 | 80 | 75 | 79 | 77 | 73 | 78 | 58 | 76 | 76 | 76 | 74 |
| 5. Chlre_RCA | 66 | 71 | 64 | 70 | | 58 | 76 | 54 | 56 | 59 | 55 | 58 | 59 | 61 | 58 | 54 | 59 | 58 | 56 | 60 | 63 | 58 | 60 | 59 | 59 |
| 6. Chequ_RCA | 81 | 87 | 78 | 85 | 69 | | 57 | 66 | 70 | 76 | 73 | 81 | 75 | 75 | 80 | 74 | 80 | 79 | 69 | 74 | 59 | 78 | 74 | 79 | 74 |

TABLE D2-continued

MatGAT results for global similarity and identity over the full length of the RCA polypeptide sequences.

| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| 7. Chlli_RCA | 67 | 72 | 65 | 71 | 87 | 70 | | 52 | 57 | 61 | 55 | 58 | 61 | 62 | 59 | 55 | 57 | 58 | 57 | 60 | 64 | 58 | 61 | 58 | 60 |
| 8. Datgl_RCA | 73 | 79 | 67 | 74 | 66 | 73 | 67 | | 59 | 65 | 66 | 73 | 63 | 65 | 72 | 63 | 73 | 68 | 61 | 66 | 52 | 69 | 64 | 68 | 64 |
| 9. Desan_RCA\\LF | 86 | 81 | 84 | 82 | 66 | 80 | 68 | 68 | | 91 | 77 | 72 | 88 | 79 | 72 | 70 | 70 | 70 | 90 | 83 | 55 | 67 | 80 | 70 | 77 |
| 10. Desan_RCA\SF | 80 | 87 | 77 | 85 | 72 | 86 | 73 | 74 | 91 | | 71 | 79 | 95 | 85 | 78 | 72 | 76 | 76 | 83 | 89 | 59 | 73 | 86 | 76 | 84 |
| 11. Glyma_RCA | 93 | 86 | 86 | 83 | 66 | 81 | 67 | 72 | 85 | 79 | | 80 | 70 | 71 | 79 | 73 | 79 | 74 | 79 | 74 | 55 | 80 | 71 | 74 | 70 |
| 12. Goshi_RCA | 86 | 93 | 81 | 88 | 72 | 89 | 71 | 78 | 82 | 88 | 85 | | 77 | 80 | 88 | 75 | 85 | 80 | 75 | 80 | 59 | 82 | 79 | 81 | 78 |
| 13. Horvu_RCA\SF | 79 | 85 | 76 | 83 | 72 | 85 | 74 | 72 | 89 | 97 | 78 | 87 | | 84 | 76 | 71 | 75 | 76 | 82 | 89 | 59 | 72 | 85 | 76 | 82 |
| 14. Horvu_RCASFII | 79 | 85 | 76 | 83 | 73 | 83 | 73 | 73 | 85 | 93 | 79 | 87 | 92 | | 77 | 71 | 79 | 75 | 79 | 85 | 59 | 75 | 96 | 78 | 83 |
| 15. Lartr_RCA\SF | 87 | 94 | 82 | 89 | 71 | 89 | 72 | 79 | 82 | 88 | 86 | 94 | 87 | 87 | | 76 | 84 | 81 | 73 | 78 | 57 | 82 | 77 | 80 | 78 |
| 16. Lycpe_RCA | 85 | 87 | 81 | 85 | 68 | 82 | 70 | 73 | 82 | 82 | 82 | 84 | 81 | 81 | 85 | | 75 | 85 | 72 | 73 | 55 | 71 | 70 | 71 | 70 |
| 17. Maldo_RCA\SF | 86 | 94 | 81 | 88 | 71 | 88 | 72 | 79 | 81 | 87 | 85 | 92 | 85 | 87 | 92 | 85 | | 81 | 73 | 78 | 58 | 80 | 78 | 82 | 77 |
| 18. Nicta_RCA | 83 | 89 | 79 | 86 | 70 | 86 | 71 | 76 | 79 | 83 | 82 | 88 | 84 | 84 | 89 | 90 | 89 | | 71 | 76 | 56 | 77 | 75 | 77 | 75 |
| 19. Orysa_RCA\LF | 88 | 83 | 84 | 82 | 67 | 79 | 68 | 68 | 95 | 88 | 87 | 84 | 87 | 85 | 83 | 83 | 81 | 80 | | 92 | 56 | 70 | 80 | 72 | 78 |
| 20. Orysa_RCA\SF | 81 | 88 | 77 | 84 | 71 | 85 | 73 | 73 | 88 | 95 | 81 | 89 | 94 | 91 | 89 | 83 | 87 | 84 | 92 | | 60 | 75 | 86 | 77 | 84 |
| 21. Ostta_RCA | 65 | 69 | 65 | 71 | 78 | 68 | 78 | 66 | 67 | 72 | 66 | 72 | 72 | 72 | 71 | 67 | 72 | 69 | 67 | 72 | | 57 | 59 | 58 | 59 |
| 22. Phavu_RCA\SF | 85 | 91 | 81 | 88 | 72 | 87 | 71 | 76 | 82 | 86 | 86 | 90 | 86 | 87 | 92 | 85 | 91 | 88 | 82 | 86 | 70 | | 74 | 76 | 77 |
| 23. Triae_RCA\SF | 80 | 86 | 77 | 84 | 72 | 85 | 73 | 71 | 86 | 93 | 79 | 87 | 92 | 97 | 87 | 82 | | 85 | 84 | 86 | 92 | 72 | 87 | | 77 | 84 |
| 24. Zanae_RCA\SF | 83 | 90 | 78 | 85 | 72 | 87 | 72 | 75 | 80 | 86 | 82 | 90 | 86 | 86 | 90 | 83 | 90 | 86 | 82 | 87 | 69 | 88 | 86 | | 74 |
| 25. Zeama_RCA\SF | 80 | 86 | 76 | 83 | 73 | 83 | 72 | 73 | 85 | 92 | 79 | 88 | 91 | 91 | 87 | 81 | 87 | 82 | 87 | 93 | 72 | 87 | 92 | 86 | |

The percentage identity between the AAA domain of the RCA polypeptide sequences useful in performing the methods of the invention can be increased to 60% amino acid identity compared to SEQ ID NO: 311.

TABLE D3

MatGAT results for global similarity and identity between the AAA domain of the RCA polypeptide sequences.

| | 1 | 2 | 3 | 4 | 5 | 6 | 7 | 8 | 9 | 10 | 11 | 12 | 13 | 14 | 15 | 16 | 17 | 18 |
|---|---|---|---|---|---|---|---|---|---|---|---|---|---|---|---|---|---|---|
| 1. AAA_Aceru_RCA | | 69 | 92 | 93 | 82 | 84 | 93 | 93 | 95 | 93 | 95 | 91 | 94 | 91 | 69 | 94 | 78 | 65 |
| 2. AAA_Anasp_RCA | 81 | | 68 | 68 | 67 | 68 | 67 | 70 | 69 | 67 | 68 | 66 | 68 | 67 | 99 | 69 | 64 | 76 |
| 3. AAA_Arath_RCA | 96 | 79 | | 92 | 81 | 82 | 92 | 92 | 94 | 92 | 95 | 91 | 92 | 92 | 68 | 94 | 78 | 65 |
| 4. AAA_Chequ_RCA | 96 | 81 | 95 | | 81 | 82 | 92 | 94 | 96 | 92 | 95 | 94 | 93 | 95 | 68 | 93 | 79 | 64 |
| 5. AAA_Chlli_RCA | 91 | 82 | 89 | 88 | | 93 | 81 | 80 | 82 | 82 | 81 | 79 | 81 | 80 | 67 | 80 | 80 | 64 |
| 6. AAA_Chlre_RCA | 90 | 83 | 89 | 88 | 95 | | 83 | 82 | 84 | 83 | 83 | 81 | 82 | 81 | 68 | 81 | 80 | 64 |
| 7. AAA_Desan_RCA | 97 | 80 | 95 | 95 | 88 | 88 | | 93 | 94 | 98 | 95 | 92 | 92 | 92 | 67 | 94 | 78 | 64 |
| 8. AAA_Glyma_RCA | 97 | 82 | 95 | 98 | 91 | 91 | 96 | | 97 | 93 | 95 | 91 | 95 | 92 | 70 | 96 | 79 | 65 |
| 9. AAA_Goshi_RCA | 98 | 81 | 96 | 97 | 90 | 90 | 97 | 99 | | 94 | 98 | 93 | 95 | 95 | 69 | 96 | 80 | 65 |
| 10. AAA_Horvu_RCA | 97 | 80 | 95 | 96 | 89 | 88 | 98 | 97 | 97 | | 94 | 92 | 91 | 92 | 67 | 95 | 78 | 64 |
| 11. AAA_Lartr_RCA | 98 | 81 | 97 | 97 | 90 | 89 | 97 | 99 | 99 | 98 | | 95 | 95 | 95 | 68 | 97 | 79 | 65 |
| 12. AAA_Lycpe_RCA | 97 | 81 | 96 | 97 | 89 | 89 | 97 | 97 | 97 | 98 | 98 | | 91 | 98 | 66 | 94 | 79 | 65 |
| 13. AAA_Maldo_RCA | 98 | 82 | 95 | 97 | 91 | 92 | 96 | 99 | 98 | 96 | 98 | 96 | | 92 | 68 | 93 | 78 | 67 |
| 14. AAA_Nicta_RCA | 96 | 80 | 95 | 96 | 89 | 89 | 95 | 97 | 98 | 96 | 97 | 99 | 96 | | 67 | 94 | 79 | 65 |
| 15. AAA_Nossp_RCA | 81 | 99 | 79 | 80 | 82 | 83 | 79 | 81 | 81 | 80 | 81 | 80 | 81 | 80 | | 69 | 64 | 75 |
| 16. AAA_Orysa_RCA | 99 | 81 | 97 | 97 | 90 | 90 | 98 | 99 | 99 | 98 | 99 | 98 | 98 | 98 | 81 | | 79 | 65 |
| 17. AAA_Ostta_RCA | 89 | 80 | 87 | 88 | 89 | 88 | 87 | 89 | 89 | 88 | 88 | 88 | 89 | 88 | 79 | 89 | | 64 |
| 18. AAA_Synco_RCA | 81 | 85 | 79 | 79 | 81 | 80 | 79 | 81 | 81 | 80 | 81 | 80 | 82 | 80 | 85 | 81 | 82 | |
| 19. AAA_Triae_RCA | 97 | 80 | 95 | 96 | 88 | 88 | 98 | 97 | 98 | 99 | 98 | 98 | 96 | 96 | 79 | 99 | 87 | 79 |

Example 37

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Interpro is hosted at the European Bioinformatics Institute in the United Kingdom.

The results of the InterPro scan of the polypeptide sequence as represented by SEQ ID NO: 251 are presented in Table D4.

TABLE D4

InterPro scan results of the polypeptide
sequence as represented by SEQ ID NO: 251

| Database | Accession number | Accession name |
|---|---|---|
| InterPro | IPR003959 | AAA ATPase, core |
| Pfam | PF00004 | AAA, ATPase family associated with various cellular activities; Clan: P-loop containing nucleoside triphosphate hydrolase superfamily; residues 133-331 of SEQ ID NO: 251. |

A key feature of the AAA family members is that they share a conserved region of about 200 amino acids that contains an ATP-binding site (P-loop). For example, the AAA domain of SEQ ID NO: 251 is as represented by SEQ ID NO: 311.

Example 38

Topology Prediction of the Polypeptide Sequences Useful in Performing the methods of the Invention (Subcellular Localization, Transmembrane . . . )

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The subcellular localization of the polypeptide sequence as represented by SEQ ID NO: 251 is the chloroplast, and the predicted length of the transit peptide is of 32 amino acids starting from the N-terminus (not as reliable as the prediction of the subcellular localization itself, may vary in length by a few amino acids). When aligning RCA polypeptides with the RCA polypeptide of SEQ ID NO: 251, it is possible to deduce the length of the transit peptide in the latter (see FIG. 15). Alternatively, in a broader definition, the transit peptide is the amino acid sequence preceding the beginning of sequence conservation between eukaryotic RCA polypeptides, as shown in FIG. 15.

Many algorithms can be used to perform such analyses, including:
- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark

Example 39

Assay Related to the Polypeptide Sequences Useful in Performing the Methods of the Invention ATP hydrolysis by RCA activity is measured by coupling ADP production to NADH oxidation as described by Li et al. ((2005) J Biol Chem 280(26): 24864-24869; and references including therein), RuBisCo activation by RCA activity is assayed spectrophotometrically as reported by Esau et al., ((1996) Arch Biochem Biophys 326: 100-105).

Example 40

Cloning of Nucleic Acid Sequence as Represented by SEQ ID NO: 250

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The nucleic acid sequence used in the methods of the invention was amplified by PCR using as template a *Chlamydomonas reinhardtii* CC-1690 cDNA library ("Core Library") (in Lambda ZAP II vector from Stratagene) purchased at the Chlamy Center (formerly the *Chlamydomonas* Genetics Center) at Duke University, North Carolina, USA. PCR was performed using Hifi Taq DNA polymerase in standard conditions, using 200 ng of template in a 50 µl PCR mix. The primers used were
  prm08444 SEQ ID NO: 310; sense, AttB1 site in lower case: 5'-ggggacaagtttgtacaaaaaagcag-gcttaaacaATGCAGGTCACCATGAAGAG-3'; and
  prm08445 SEQ ID NO: 311 reverse, complementary, AttB2 site in lower case: 5'-ggggaccactttgtacaa-gaaagctgggtCTCCTACAGAGGAGGCACATC-3',
which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", p15972. Plasmid pDONR201 was purchased from Invitrogen, as part of the Gateway® technology.

Example 41

Expression Vector Construction Using the Nucleic Acid Sequence as Represented by SEQ ID NO: 250

The entry clone comprising SEQ ID NO: 250 was subsequently used in an LR reaction with three different destination vectors used subsequently and individually for *Oryza sativa* transformation. The vectors contains as functional elements within the T-DNA borders: a plant selectable marker; a screenable marker expression cassette; and a Gateway cassette intended for LR in vivo recombination with the nucleic acid sequence of interest already cloned in the entry clone. The first destination vector comprises upstream of this Gateway cassette the rice GOS2 promoter (SEQ ID NO: 306) for strong constitutive expression, the second destination vector comprises the rice HMGB promoter for constitutive expression (SEQ ID NO: 307), and the third destination vector comprises the rice protochlorophyllide reductase promoter for specific expression in green tissue (SEQ ID NO: 308).

Figure 16:
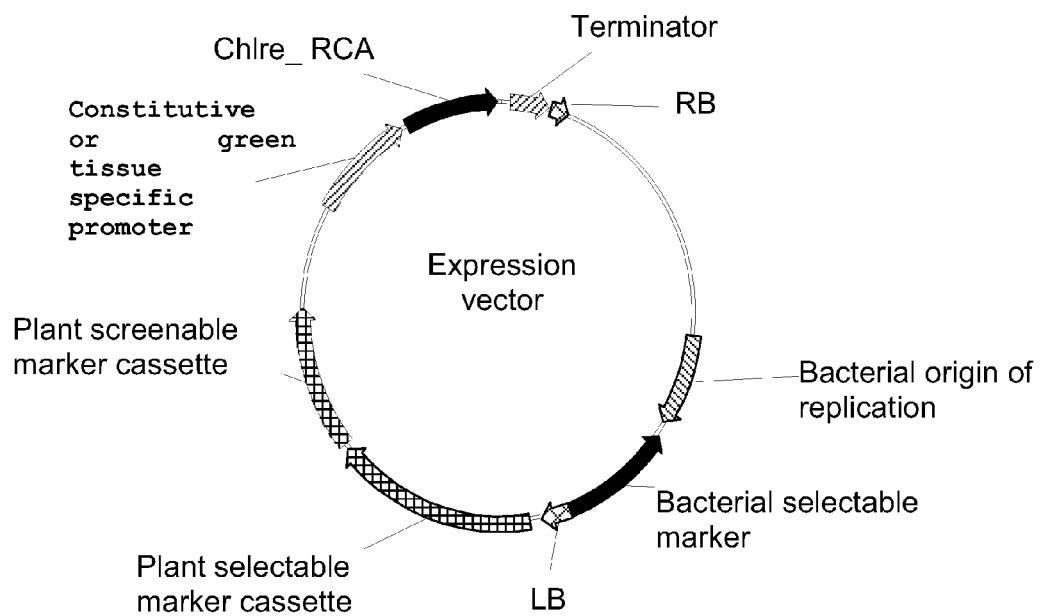
FIG. 16 shows the binary vector for increased expression in *Oryza sativa* of a nucleic acid sequence encoding a *Chlamydomonas reinhardtii* RCA polypeptide under the control of a constitutive promoter, or under the control of a green tissue-specific promoter.

After the LR recombination step, the resulting expression vectors (FIG. 16) were separately transformed into *Agrobacterium* strain LBA4044 according to methods well known in the art.

Example 42

Plant Transformation

See Example 9 above

Example 43

Phenotypic Evaluation Procedure

See Examples 10 and 22 above

Example 44

Results of the Phenotypic Evaluation of the Transgenic Plants Expressing SEQ ID NO: 250 Under the Control of a Strong Constitutive Promoter The results of the evaluation of transgenic rice plants expressing the nucleic acid sequence useful in performing the methods of the invention, under the control of a strong constitutive GOS2 promoter (SEQ ID NO: 306), are presented in Table D5. The percentage difference between the transgenics and the corresponding nullizygotes is also shown, with a P value from the F test below 0.05.

The transgenic plants expressing the nucleic acid sequence useful in performing the methods of the invention, have increased early vigour and increased TKW compared to the control plants (in this case, the nullizygotes).

TABLE D5

Results of the evaluation of transgenic rice plants expressing the nucleic acid sequence useful in performing the methods of the invention, under the control of a strong constitutive GOS2 promoter.

| Trait | % Increase in T1 generation | % Increase in T2 generation |
| --- | --- | --- |
| Increased early vigour | 8 | 17 |
| TKW | 7 | 28 |

Example 45

Results of the Phenotypic Evaluation of the Transgenic Plants Expressing SEQ ID NO: 250 Under the Control of a Constitutive Promoter The results of the evaluation of transgenic rice plants expressing the nucleic acid sequence useful in performing the methods of the invention, under the control of a constitutive HMGB promoter (SEQ ID NO: 307), are presented in Table D6. The percentage difference between the transgenics and the corresponding nullizygotes is also shown, with a P value from the F test below 0.05.

The transgenic plants expressing the nucleic acid sequence useful in performing the methods of the invention, have increased early vigour, increased aboveground biomass and increased number of filled seeds compared to the control plants (in this case, the nullizygotes). Transgenic plants flower earlier compared to the corresponding nullizygotes, by up to 3 days.

TABLE D6

Results of the evaluation of transgenic rice plants expressing the nucleic acid sequence useful in performing the methods of the invention, under the control of a constitutive HMGB promoter.

| Trait | % Increase in T1 generation | % Increase in T2 generation |
| --- | --- | --- |
| Increased early vigour | 12 | 8 |
| Increase in aboveground biomass | 11 | 5 |
| Increase in number of (filled) seeds | 11 | 9 |

Example 46

Results of the Phenotypic Evaluation of the Transgenic Plants Expressing SEQ ID NO: 250 Under the Control of a Green Tissue-Specific Promoter The results of the evaluation of transgenic rice plants expressing the nucleic acid sequence useful in performing the methods of the invention, under the control of a protochlorophyllide reductase (SEQ ID NO: 308) promoter, are presented in Table D7. The percentage difference between the transgenics and the corresponding nullizygotes is also shown, with a P value from the F test below 0.05.

The transgenic plants expressing the nucleic acid sequence useful in performing the methods of the invention, have increased early vigour compared to the control plants (in this case, the nullizygotes). Transgenic plants flower earlier compared to the corresponding nullizygotes, by up to 4 days.

TABLE D7

Results of the evaluation of transgenic rice plants expressing the nucleic acid sequence useful in performing the methods of the invention, under the control of a protochlorophyllide reductase promoter.

| Trait | % Increase in T1 generation | % Increase in T2 generation |
| --- | --- | --- |
| Increased early vigour | 18 | 8 |

Example 47

Examples of Transformation of Other Crops

See Example 9 above

Example 48

Examples of Abiotic Stress Screens

See Example 22 above

Part V. SYPF1

Example 49

Identification of Sequences Related to SEQ ID NO: 321 and SEQ ID NO: 322

Sequences (full length cDNA, ESTs or genomic) related to SEQ ID NO: 321 and/or protein sequences related to SEQ ID NO: 322 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. The polypeptide encoded by SEQ ID NO: 321 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

Table E1 provides a list of nucleic acid and protein sequences related to the nucleic acid sequence as represented by SEQ ID NO: 321 and the protein sequence represented by SEQ ID NO: 322.

TABLE E1

Nucleic acid sequences encoding SYPF1 polypeptides and SYPF1 polypeptides.

| Name | Source organism | Nucleic acid SEQ ID NO: | Polypeptide SEQ ID NO: |
|---|---|---|---|
| SEQ ID NO: 322 | Arabidopsis thaliana | 321 | 322 |
| At4g18690 | Arabidopsis thaliana | 323 | 324 |
| At4g18680 | Arabidopsis thaliana | 325 | 326 |
| At4g18650 | Arabidopsis thaliana | 327 | 328 |
| NP_564730.1 | Arabidopsis thaliana | 329 | 330 |
| At5g10030 | Arabidopsis thaliana | 331 | 332 |
| CAA40102.1 | Triticum aestivum | 333 | 334 |
| Os01g0159000 | Oryza sativa | 335 | 336 |
| Os01g0306400 | Oryza sativa | 337 | 338 |
| BAA05470.1 | Nicotiana glauca × Nicotiana langsdorfii | 339 | 330 |
| AAT64037.1 | Gossypium hirsutum | 331 | 332 |
| At4g18690 | Arabidopsis thaliana | — | 333 |
| NP_193603.1 | Arabidopsis thaliana | — | 334 |
| NP_193600.2 | Arabidopsis thaliana | — | 335 |
| P_564730.1 | Arabidopsis thaliana | — | 336 |
| At5g10030 | Arabidopsis thaliana | — | 337 |
| CAA40102.1 | Triticum aestivum | — | 338 |
| OS01g0159000 | Oryza sativa | — | 339 |
| Os01g0306400 | Oryza sativa | — | 340 |
| BAA05470.1 | Nicotiana glauca × Nicotiana langsdorfii | — | 341 |
| AAT64037.1 | Gossypium hirsutum | — | 342 |

Example 50

Alignment of SYPF1 Polypeptide Sequences

Alignment of polypeptide sequences was performed using the AlignX programme from the Vector NTI (Invitrogen) which is based on the popular Clustal algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0.1 and the selected weight matrix is Blosum 62 (if polypeptides are aligned). Results in FIG. 19 show that SYPF1 polypeptides share regions of high sequence conservation. Motif 1, Motif 2 and Motif 3 represent the regions with highest sequence homology.

Figure 20:
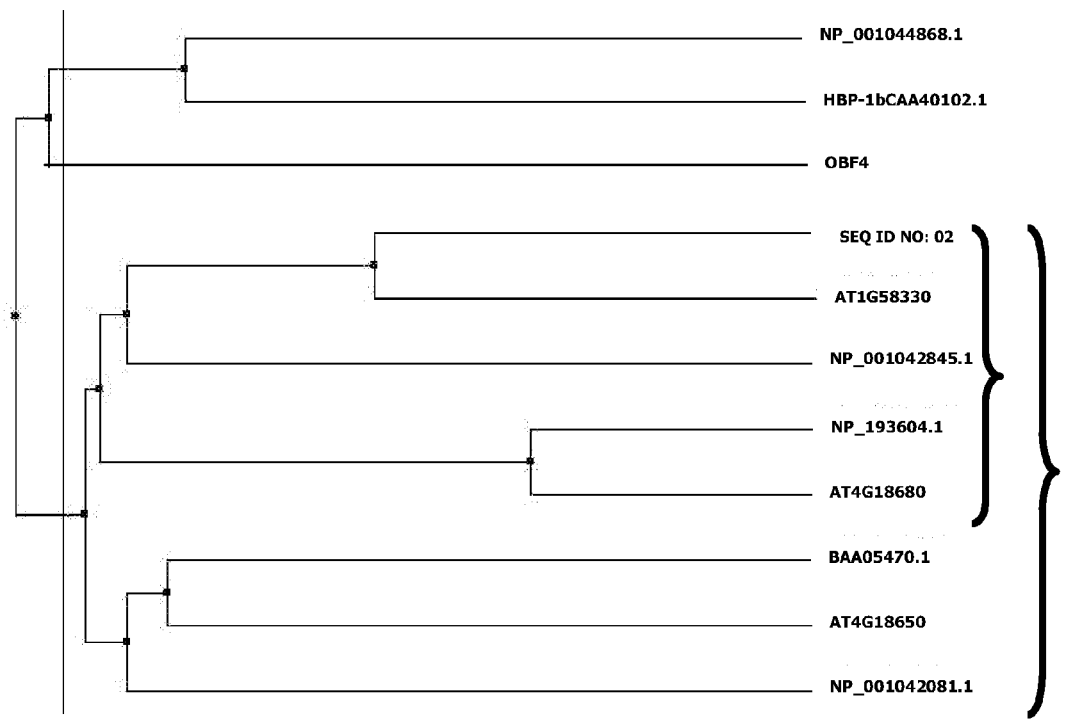
FIG. 20 shows a phylogenetic tree comprising SYP1 polypeptide sequences. Sequences clustering with the sequence of SEQ ID NO: 322 may be useful in performing the methods of the invention.

A phylogenetic tree of SYPF1 polypeptides was constructed using a neighbour-joining clustering algorithm as provided in the AlignX programme from the Vector NTI (Invitrogen). FIG. 20 shows how SYPF1 polypeptides cluster with SEQ ID NO: 322.

Example 51

Cloning of Nucleic Acid Sequence as Represented by SEQ ID NO: 321

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Arabidopsis thaliana* SYPF1 gene was amplified by PCR using as template an *Arabidopsis thaliana* cDNA library (Invitrogen, Paisley, UK). Primers (SEQ ID NO: 353; sense, 5'-ggggacaagtttgtacaaaaaagcag-gcttaaacaatgccaaacactagcagctc t-3') and SEQ ID NO: 354; reverse, complementary, 5'-ggggaccactttgtacaag aaagctggg-tagaagcagagcaaagcaaatta-3'), which include the AttB sites for Gateway recombination, were used for PCR amplification. PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

Example 52

Expression Vector Construction Using the Nucleic Acid Sequence as Represented by SEQ ID NO: 321

The entry clone comprising SEQ ID NO: 321 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice HMG promoter (SEQ ID NO: 355) for root specific expression was located upstream of this Gateway cassette.

Figure 21:
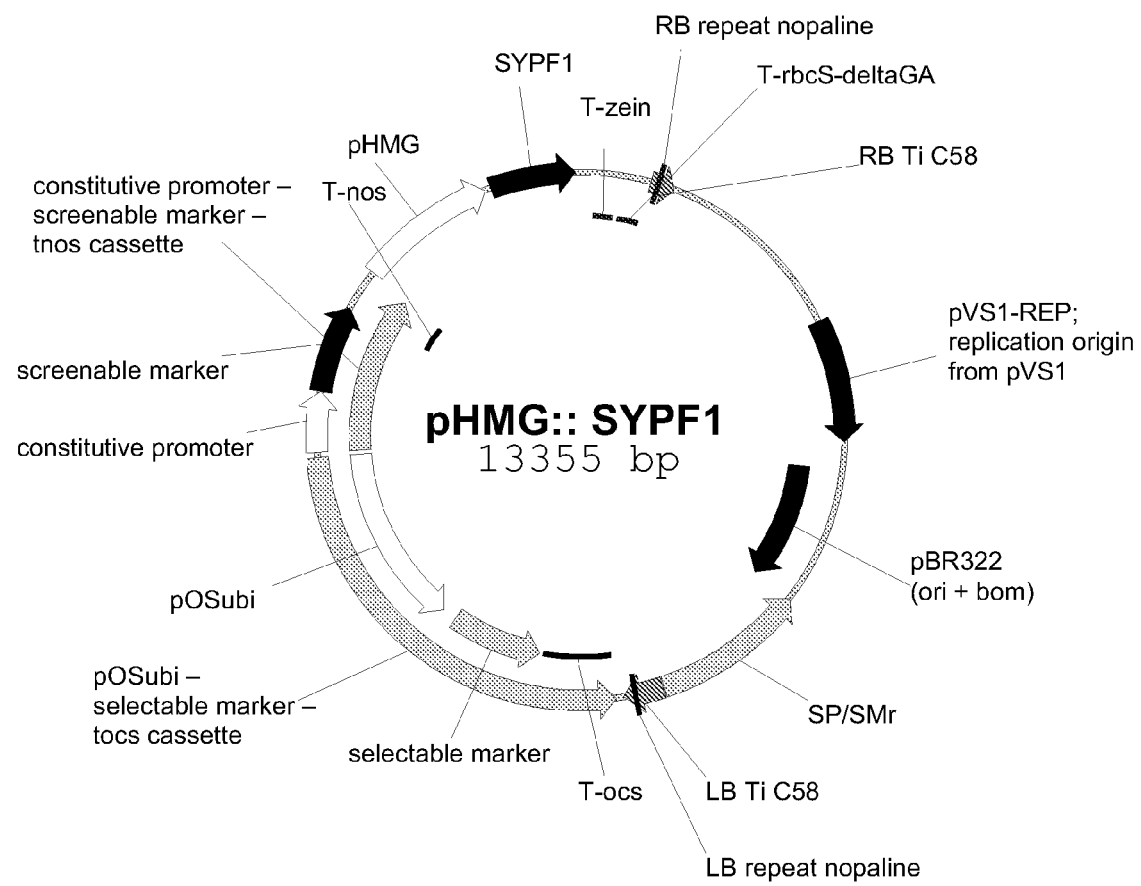
FIG. 21 shows the binary vector for increased expression in *Oryza sativa* of an *Arabidopsis thaliana* SYPF1 protein-encoding nucleic acid under the control of a HMG promoter.

After the LR recombination step, the resulting expression vector pHMG::SYPF1 (FIG. 21) was transformed into *Agrobacterium* strain LBA4044 according to methods well known in the art.

Example 53

Plant Transformation

See Example 9 above

Example 54

Phenotypic Evaluation Procedure

See Examples 10 and 22 above

Example 55

Results of the Phenotypic Evaluation of the Transgenic Plants

The results of the evaluation of transgenic rice plants expressing the SYPF1 nucleic acid are as follows.

There was a statistically significant increase in the fill rate of seeds, the number of filled seeds, the total seed weight and the harvest index compared to corresponding nullizygotes (controls). For the fill rate, the best 3 lines showed a 16% or more increase compared to control plants. In the case of the number of filled seeds, the best 4 lines gave a 19% or more increase compared to control plants. The total weight of seeds was increased in the best 4 lines by 19% or more and, for harvest index, the best 3 lines gave a greater than 20% increase compared to control plants.

SEQUENCE LISTING (362 sequences)

SEQ ID NO: 1 - DNA, 1827 bp, Arabidopsis thaliana
atggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatga

SEQ ID NO: 2 - protein, 608 aa, Arabidopsis thaliana
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 3 - DNA, 1938 bp, Arabidopsis thaliana
atggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaagcctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcgagatcaaaacttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcctgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagggaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatga

SEQ ID NO: 4 - protein, 645 aa, Arabidopsis thaliana
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQNLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 5 - DNA, 882 bp, Arabidopsis thaliana
atgacctcaaccaatccggtggtcgccgaagtaataccggcggaaacttctacagatgctacagagacgacgattgcaacgacggaagctggtgaagcaccggagaagaaggtgaggaaagcttacacaatcaccaagtctagagagagttggactgaaggagaacacgacaagtttctggaagctcttcaattgtttgatcgtgactggaaaaagatagaagattttgttggttcaaagacagttattcagatcaggagccatgcccaaaaatactttctaaaggtccaaaaaaatgggactttagcacatgttccaccccctaggcctaagcgcaaagctgctcatccatatcctcaaaaggcatcgaaaaatgctcaaatgtcgcttcacgtttccatgtcctttcctactcaaataaataacctgcctggatatactccatgggatgatgatacatctgcattgttaaacattgctgtaagtggggttattccaccagaagatgaacttgatactctttgtggagcagaagttgatgttggatcaaatgacatgataagtgaaactagtccttcagcatctggtatcggaagctcaagcagaacactatcagattctaagggtttgagactggcgaaacaagctccctcaatgcatggtcttcctgattttgctgaggtttataacttcattgggagtgtgttcgatcctgacagcaaaggccgcatgaaaaagctcaaggaaatggatcctataaatttcgaaactgttttgctgttgatgagaaacctcacagtgaacttgtcaaaccctgactttgaacctacttctgaatatgttgatgctgcagaggaaggtcatgaacacttaagctcttag

SEQ ID NO: 6 - protein, 293 aa, Arabidopsis thaliana
MTSTNPVVAEVIPAETSTDATETTIATTEAGEAPEKKVRKAYTITKSRESWTEGEHDKFLEALQLFDRDWKKIEDFVGSKTVIQIRSHAQKYFLKVQKNGTLAHVPPPRPKRKAAHPYPQKASKNAQMSLHVSMSFPTQINNLPGYTPWDDDTSALLNIAVSGVIPPEDELDTLCGAEVDVGSNDMISETSPSASGIGSSSRTLSDSKGLRLAKQAPSMHGLPDFAEVYNFIGSVFDPDSKGRMKKLKEMDPINFETVLLLMRNLTVNLSNPDFEPTSEYVDAAEEGHEHLSS

SEQ ID NO: 7 - DNA, 993 bp, Arabidopsis thaliana
atggtctctagaaattctgacggatatttcttggatccgaccggtatgactgttcctggtctcggaccttcctttacagccgccgtttcttcttcttcttcaccaacgacttcttctacggccgtggctgtggcggatgtgacggcgatggtttcttcttcggaggaggatttgagtaagaagattaggaagccttatactattactaagtctagagagagctggacggagcctgagcatgataaattccttgaagctcttcaattgtttgatagagactggaagaagattgaagcttttattggttcaaagacagtgattcagatacgaagtcatgctcagaagtattttcttaaggtacaaaagagtgggaccggtgaacatctccctcctcctcgacctaaaaggaaagccgctcatccatatcctcagaaggctcacaagaatgtgcaactgcaagtaccagggtcattcaagtcaacatctgaaccaaatgacccaagttttatgtttaggcctgagtcttcttcaatgctgatgacttcgccaaccactgctgctgcggctccatggacaaataatgcgcaaacaattagcttcactcccctcccaaaaggagcaggagctaataacaattgttctagtagttctgaaaatactccaagaccacgatccaacagggacgcaagagaccatggaaatgttggccattcattaagagttttaccggactttgcccaagtatacggcttcattggaagtgtgtttgacccatatgcaagtaatcatctacaaaagctgaagaagatggaccccatagatgttgaaacagtgttactattgatgagaaatctatccatcaacttgtctagtcctgactttgaggatcatagacggcttctttcgtcttatgatatcggatctgagacagcaactgatcatggtggagtgaataaaaccttaaacaaagacccacctgaaatctctacttaa

SEQ ID NO: 8 - protein, 330 aa, Arabidopsis thaliana
MVSRNSDGYFLDPTGMTVPGLGPSFTAAVSSSSSPTTSSTAVAVADVTAMVSSSEEDLSKKIRKPYTITKSRESWTEPEHDKFLEALQLFDRDWKKIEAFIGSKTVIQIRSHAQKYFLKVQKSGTGEHLPPPRPKRKAAHPYPQKAHKNVQLQVPGSFKSTSEPNDPSFMFRPESSSMLMTSPTTAAAAPWTNNAQTISFTPLPKGAGANNNCSSSSENTPRPRSNRDARDHGNVGHSLRVLPDFAQVYGFIGSVFDPYASNHLQKLKKMDPIDVETVLLLMRNLSINLSSPDFEDHRRLLSSYDIGSETATDHGGVNKTLNKDPPEIST

SEQ ID NO: 9 - DNA, 864 bp, Arabidopsis thaliana
atggtgactgtaaaccctagccaagctcattgtttgcctatgaaaatgagtctaccgggtttcaatactcttccccacacggcaacaacgataccggtttccatacggagcaataggacgatgtcgttttttgaggatccaacaaagaaggttagaaagccttacactatcaccaaatctagagagaactggacggagcaagaacacgacaagttccttgaagcccttcatctatttgaccgggattggaagaaaataaaggcctttgttggatcaaaaacagtgatacagatacgaagccacgcacagaagtactttctcaaagttcagaagaatgggactaaagaacatctcccacctcctcgaccaaagaggaaagccaatcacccatatccacaaaaagctcctaaatttactctttcttcttcaaacgcattatttcaacatgactacttatacaacactaattcacatccggtgattagcaccacccgtaagcatggattagtgcattgcgatgttagtataccaagttctgttatcaaagaggaatttggtgtctcagagaactgttgcagcactagtagtagtagagataagcagaggactagaatcgttacagagacaaatgaccaagaaagttgtggaaagccacatagagtggcgccaaatttcgctgaagtttacaattttataggaagtgtgtttgatcctaaaacaacaggtcatgtcaagagattaaaggaaatggatccaataaatcttgagacggttctcttactgatgaaaaatttatctgtaaacctgacgagtcccgagtttgatgaacaacggaagttgatatcatcttacaacgccagttag

SEQ ID NO: 10 - protein, 287 aa, Arabidopsis thaliana
MVTVNPSQAHCLPMKMSLPGFNTLPHTATTIPVSIRSNRTMSFFEDPTKKVRKPYTITKSRENWTEQEHDKFLEALHLFDRDWKKIKAFVGSKTVIQIRSHAQKYFLKVQKNGTKEHLPPPRPKRKANHPYPQKAPKFTLSSSNALFQHDYLYNTNSHPVISTTRKHGLVHCDVSIPSSVIKEEFGVSENCCSTSSSRDKQRTRIVTETNDQESCGKPHRVAPNFAEVYNFIGSVFDPKTTGHVKRLKEMDPINLETVLLLMKNLSVNLTSPEFDEQRKLISSYNAS

SEQ ID NO: 11 - DNA, 909 bp, Arabidopsis thaliana
atggtgtccgtaaaccctagacctaagggttttccagttttcgattcctcgaatatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacctcctcgacctaagaggaaagcgagtcatccttatcctataaaggctcctaaaaatgttgcttatacctctctcccgtcttcgagtacattaccgttgcttgagcctggttatttgtatagctctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtttacagcttcattggaagtgtcttcgatcccaacacatcaggccacctccagagattaaagcagatggatccaataaatatggaaacggttcttttactgatgcaaaacctgtctgtaaatctgacaagtcccgagtttgcagagcaaaggaggttgatatcatcatacagcgctaaagctttgaaatag

SEQ ID NO: 12 - protein, 302 aa, Arabidopsis thaliana
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPPPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 13 - DNA, 849 bp, Arabidopsis thaliana
atgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaagctgatattggatcaaagggcttattaaatgttagtagcccttctacatctggcatgggaagctcaagccgaacagtatcaggttctgagattgtaagaaaggctaaacagcctccagtgcttcacggtgttcctgattttgctgaagtttataatttcattgggagtgtctttgatcctgaaacgagaggccatgtggaaaagctcaaggaaatggatcctataaatttcgaaactgttctgttattgatgagaaacctcacagttaacttatcaaaccctgatttagaatccacttcggattgtaatgatgctgcagaggaaagtcctcttatcatatga

SEQ ID NO: 14 - protein, 282 aa, Arabidopsis thaliana
MSSSPSRNPTNAEAPPPPPTSTDAVAEGSSKKVRKPYTITKSRESWTEEEHDKFLEALQLFDRDWKKIEDFVGSKTVIQIRSHAQKYFLKVQKNGTLAHVPPPRPKRKAAHPYPQKASKNAQMPLQVSTSFTTTRNGDMPGYASWDDASMLLNRVISPQHELATLRGAEADIGSKGLLNVSSPSTSGMGSSSRTVSGSEIVRKAKQPPVLHGVPDFAEVYNFIGSVFDPETRGHVEKLKEMDPINFETVLLLMRNLTVNLSNPDLESTSDCNDAAEESPLII

SEQ ID NO: 15 - DNA, 1041 bp, Arabidopsis thaliana
atggccgctgaggatcgaagtgaggaactaagcagcaatgtagaaaatggaagttgcaattccaatgaaggaattaatcctgaaaccagcagtcattggattgaaaacgttgtcaaggttaggaaaccgtacacagtaactaagcagagagagaagtggagtgaggaagagcatgataggtttcttgaagctatcaagctttatggtcgtggttggcgtcaaatccaagaacacataggtacaaaaaccgctgtgcagatacgaagccatgctcaaaagttcttctccaagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaagtcaatagatgctcttcgcctaattcgtgtaccagtgacatccaatccattggtgcaacttccattgataaaaagaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaaaagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctag

SEQ ID NO: 16 - protein, 346 aa, Arabidopsis thaliana
MAAEDRSEELSSNVENGSCNSNEGINPETSSHWIENVVKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQVNRCSSPNSCTSDIQSIGATSIDKKNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 17 - DNA, 889 bp, Arabidopsis thaliana
atggccgccgttagtagttcgtcggagaccggagactgcggcgttacgggaaagagagatgagatcatgttgttcggagttagagtcgtggttgatccgatgagaaagtgtgtgagtttgaacaatctctctgattatgaaaagtcttctccggaggatgagatccctaagatagtcaccgccggagctggagatggtgaagataagaacgaaacggatgcgacggtgattgtcgctgacggttacgcctccgccaatgacgctgtccagatttcgtcttcttccggcgggaggaaacgaggggttccatggacagagaacgagcataagaggttcttgattgggttgcagaaagtaggaaaaggagattggaaaggaatatcaagaaactttgtgaagagtaggactcctactcaagtagctagtcatgctcagaaatacttcctccgacgaaccaacctcaaccgtcgccgaagaagatctagcctttttgatatcactactgagacggttacagaaatggccatggagcaagatcctactcaggagaactcaccactacctgaaaccaacatcagctctggacagcaagcgatgcaagtttttactgacgtgccgacaaaaactgagaatgcaccagagacatttcatctcaacgatccatatctggttccagtaaccttccaagcaaagccaacattcaatctaaacacagatgctgctccactttctctcaacctttgtctggcatcctcatttaatcttaacgagcaacccaactcaagacactcggctttcacgatgatgccaagcttcagcgatggagatagcaatagcagcatcatcagagttgcttagagcttaaacccaaggtgaatctacaagacct

SEQ ID NO: 18 - protein, 285 aa, Arabidopsis thaliana
MAAVSSSSETGDCGVTGKRDEIMLFGVRVVVDPMRKCVSLNNLSDYEKSSPEDEIPKIVTAGAGDGEDKNETDATVIVADGYASANDAVQISSSSGGRKRGVPWTENEHKRFLIGLQKVGKGDWKGISRNFVKSRTPTQVASHAQKYFLRRTNLNRRRRRSSLFDITTETVTEMAMEQDPTQENSPLPETNISSGQQAMQVFTDVPTKTENAPETFHLNDPYLVPVTFQAKPTFNLNTDAAPLSLNLCLASSFNLNEQPNSRHSAFTMMPSFSDGDSNSSIIRVA

SEQ ID NO: 19 - DNA, 786 bp, Arabidopsis thaliana
atgtcacgtagttgctcacagtgtggaaacaacggccacaactctcgcacatgtccgacggacataactaccaccggtgacaacaacgacaaaggcggcggggagaaagccatcatgctttttggcgtccgcgtcacggaagcttcatcatcttgttttagaaaaagtgttagtatgaacaatctctctcaattcgatcaaactcctgatcccaacccaaccgatgacggtggttacgcttcagacgacgtcgttcacgcctccggtagaaaccgtgaacgcaaacgaggaactccatggacagaggaagaacatagattgtttcttactggattgcataaagttggaaaaggtgattggagaggaatctctagaaactttgttaaaactcgaacacctactcaggtagcgagtcatgctcagaaatattttctccggcggactaatcagaatcgtcgtcgtcgtagatcaagcctcttcgatatcactcccgattcgtttataggatcatcaaaagaagagaatcagttacagactccattggagctaatccgtccagttccgattcctattccgattccaccgtcgcggaagatggctgatttgaatcttaacaagaaaaaaactccagcgacaacggagatgtttccgctgtcgctgaatttgcagaggccgtcttcgtcgacatcgtcatcgtccaatgaacagaaggcacgtggctcacgtgcctcctcggggttcgaggcgatgtcgagtaatggagatagtataatgggagtggcttga

SEQ ID NO: 20 - protein, 261 aa, Arabidopsis thaliana
MSRSCSQCGNNGHNSRTCPTDITTTGDNNDKGGGEKAIMLFGVRVTEASSSCFRKSVSMNNLSQFDQTPDPNPTDDGGYASDDVVHASGRNRERKRGTPWTEEEHRLFLTGLHKVGKGDWRGISRNFVKTRTPTQVASHAQKYFLRRTNQNRRRRRSSLFDITPDSFIGSSKEENQLQTPLELIRPVPIPIPIPPSRKMADLNLNKKKTPATTEMFPLSLNLQRPSSSTSSSSNEQKARGSRASSGFEAMSSNGDSIMGVA

SEQ ID NO: 21 - DNA, 798 bp, Arabidopsis thaliana
atggccgacggtagtactagttcttcggagtccactaccgcctgcgctggaagcggcacaagaagagagattatgctgttcggagtcagggttgtgcttgacccgatgagaaagtgcgtgagtttgaacaatctgtctgactatgaacagacggcggagactccaaagatcgacggcgaagatagagatgaacaagatatgaacaaaaccccggccggttacgcctcggcggatgaagctcttcccatgtcttcttctaacggcaaaatcgagaggaaacgaggagttccatggactgaagaagaacacaagctgttcttgcttgggctgcagagagtcggtaaaggagattggaaaggaatatcaagaaactttgtcaagaccagaacctctacacaagttgctagtcatgctcagaaatacttcctcaggcgaagtaatcttaaccgtcgccgccgaagatctagcctttttgacatgactactgatacggtcatacccatggaagaagatcaccaagtgcttatacaggagaacacatctcaatcatcttctcctgtaccggaaatcaacaacttctctatacatccggttatgcaagtctttcccgagttcccggtaccaacagggaatcaatcatacggacagcttacttcatcgaatctcatcaatttggttccattaacttttcagtcaagtccagcaccgctttctctcaacctctcactagcttcatctaatcttaatgaaccatctccttcaatgcatccagcattcaacacgattggagtcgcttag

SEQ ID NO: 22 - protein, 265 aa, Arabidopsis thaliana
MADGSTSSSESTTACAGSGTRREIMLFGVRVVLDPMRKCVSLNNLSDYEQTAETPKIDGEDRDEQDMNKTPAGYASADEALPMSSSNGKIERKRGVPWTEEEHKLFLLGLQRVGKGDWKGISRNFVKTRTSTQVASHAQKYFLRRSNLNRRRRRSSLFDMTTDTVIPMEEDHQVLIQENTSQSSSPVPEINNFSIHPVMQVFPEFPVPTGNQSYGQLTSSNLINLVPLTFQSSPAPLSLNLSLASSNLNEPSPSMHPAFNTIGVA

SEQ ID NO: 23 - DNA, 1011 bp, Arabidopsis thaliana
atggtaatgatgattattatatataccgaacccgaaatcagcttgtttccacttcaggatcgaagtgaggaactaagcagcaatgtagaaaatggaagttgcaattccaatgaaggaattaatcctgaaaccagcagtcattggattgaaaacgttgtcaaggttaggaaaccgtacacagtaactaagcagagagagaagtggagtgaggaagagcatgataggtttcttgaagctatcaagctttatggtcgtgggtggcgtcaaatccaagaacacataggtacaaaaaccgctgtacagatacgaagccatgctcaaaagttcttctccaagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaaaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaagagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctag

SEQ ID NO: 24 - protein, 336 aa, Arabidopsis thaliana
MVMMIIIYTEPEISLFPLQDRSEELSSNVENGSCNSNEGINPETSSHWIENVVKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 25 - DNA, 864 bp, Arabidopsis thaliana
atggatgcagcaattccgatttggaagagggacgatgataagcgttttgagttagctctggttcgattccctgctgagggttcgccggattttttagagaatatcgctcagtttctgcagaaaccgttaaaggaggtgtactcctactaccaagccttggtcgatgatgttacgctgatcgaatcgggtaagtatcctttgcccaagtacccggaagatgattacgtgtcactgccggaagcgactaagtctaaaacccagggcacggggaaaaagaagggaataccttggtcaccagaagaacacagattgtttttggatggactaaacaagtatgggaaaggagattggaagagcatatcgagggaatgtgtgacgtcaaggagcccgatgcaagtggcaagccatgctcagaagtatttcttaaggcaaaaaaataagaaggggaaacgcttcagtatccatgatatgactctgggagatgccgaaaatgtaaccgtccctgtatccaacttgaattctatgggccagcagccacattttgatgaccaaagtcctccggatcattatcaagactacttctcccagagcaatgtaaccatccctggatgcaacatgcactttatgggccagcaaccacgttttggtgaccaaattcctccgggtgaatatcacccctactcccgggacaatgtaaccgtcactggatccaacttgaattctattggccagcagccacattttaatgaccaaatttctccggatcaatatggccgctacttgcaggaaaacttcgggtttttcgatgatgatggtgaagatgatgggagtttagcaagctttcaacaactatacaaggcttaa

SEQ ID NO: 26 - protein, 287 aa, Arabidopsis thaliana
MDAAIPIWKRDDDKRFELALVRFPAEGSPDFLENIAQFLQKPLKEVYSYYQALVDDVTLIESGKYPLPKYPEDDYVSLPEATKSKTQGTGKKKGIPWSPEEHRLFLDGLNKYGKGDWKSISRECVTSRSPMQVASHAQKYFLRQKNKKGKRFSIHDMTLGDAENVTVPVSNLNSMGQQPHFDDQSPPDHYQDYFSQSNVTIPGCNMHFMGQQPRFGDQIPPGEYHPYSRDNVTVTGSNLNSIGQQPHFNDQISPDQYGRYLQENFGFFDDDGEDDGSLASFQQLYKA

SEQ ID NO: 27 - DNA, 621 bp, Arabidopsis thaliana
atggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttag

SEQ ID NO: 28 - protein, 206 aa, Arabidopsis thaliana
MASSPRWTEDDNRRFKSALSQFPPDNKRLVNVAQHLPKPLEEVKYYYEKLVNDVYLPKPLENVTQHLQKPMEMEEMKYMYEKMANDVNQMPEYVPLAESSQSKRRKKDTPNPWTEEEHRLFLQGLKKYGEGASTLTSTNFVKTKTPRQVSSHAQYYKRQKSDNKKEKRRSIFDITLESTEGNPDSGNQNPPDDDDPSQGQGTCLGV

SEQ ID NO: 29 - DNA, 1164 bp, Arabidopsis thaliana
atgactcgtcggtgttcgcattgtagcaacaatgggcacaattcacgcacgtgtccaacgcgtggtggtggcacgtgcggtggaagtggcggaggaggaggaggtggtggtggaggagggtctggttcctcctccgccatgaagttatttggtgtgaggttaacggatggctcgattattaaaaagagtgcgagtatgggtaatctctcggcattggctgttgcggcggcggcggcaacgcaccaccgtttatctccgtcgtctcctctggcgacgtcaaatcttaatgattcgccgttatcggatcatgcccgatactctaatttgcatcataatgaagggtatttatctgatgatcctgctcatggttctgggtctagtcaccgtcgtggtgagaggaagagaggtgttccttggactgaagaggaacatagactattcttagtcggtcttcagaaactcgggaaaggagattggcgcggtatttcgagaaactatgtaacgtcaagaactcctacacaagtggctagtcatgctcaaaagtattttattcgacatactagttcaagccgcaggaaaagacggtctagcctcttcgacatggttacagatgagatggtaaccgattcatcgccaacacaggaagagcagaccttaaacggttcctctccaagcaaggaacctgaaaagaaaagctaccttccttcacttgagctctcactcaataataccacagaagctgaagaggtcgtagccacggcgccacgacaggaaaaatctcaagaagctatagaaccatcaaatggtgtttcaccaatgctagtcccgggtggcttctttcctccttgttttccagtgacttacacgatttggctccctgcgtcacttcacggaacagaacatgccttaaacgctgagacttcttctcagcagcatcaggtcctaaaaccaaaacctggatttgctaaagaacgtgtgaacatggacgagttggtcggtatgtctcagcttagcataggaatggcgacaagacacgaaaccgaaacttccccttccccgctatctttgagactagagccctcaaggccatcagcgtttcactcgaatggctcggttaatggtgcagatttgagtaaaggcaacagcgcgattcaggctatctaa

SEQ ID NO: 30 - protein, 387 aa, Arabidopsis thaliana
MTRRCSHCSNNGHNSRTCPTRGGGTCGGSGGGGGGGGGGGSGSSSAMKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 31 - DNA, 634 bp, Arabidopsis thaliana
atggccgcgtttccgcagtggacaagggtcgatgacaaacgttttgagttagctctgcttcaaatcccggagggttcgccgaattttatagagaatatcgcctattatctccagaaaccggtgaaggaggtggagtactactactgcgcgttggtccatgatattgagcggatcgaatcgggtaagtatgttttgcccaaatacccggaagacgattacgtgaaactgacggaagcaggtgagtctaagggcaatgggaaaaagacgggaattccttggtcagaagaggaacagaggttgtttctggaaggactaaataagtttgggaaaggagactggaagaacatatcgaggtattgtgtgaagtcaaggacctcgacgcaagtggcaagccatgctcagaagtattttgcaaggcaaaagcaggagagtacgaatactaaacgcccgagtattcatgacatgactctgggagttgcggtcaatgtccctggatccaacttggagtctactggccagcaaccacattttggtgatcaaattccttcgaatcaatattatccctcccaggaaaactttcggggttttgatcagcgatggtgatgggtgtatggcaaacttatactacgcttaa

SEQ ID NO: 32 - protein, 200 aa, Arabidopsis thaliana
MAAFPQWTRVDDKRFELALLQIPEGSPNFIENIAYYLQKPVKEVEYYYCALVHDIERIESGKYVLPKYPEDDYVKLTEAGESKGNGKKTGIPWSEEEQRLFLEGLNKFGKGDWKNISRYCVKSRTSTQVASHAQKYFARQKQESTNTKRPSIHDMTLGVAVNVPGSNLESTGQQPHFGDQIPSNQYYPSQENFRGFDQRW

SEQ ID NO: 33 - DNA, 864 bp, Arabidopsis thaliana
atggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaagacgctgaaacagaagtggtagtgtcggagttcaaaagaagtgagagatcagctttctctcagttaaaatcgtcggtgactgagatgaacaacatgagagggttcatgccttacaaaaagagagtaaaggtggaagaaaacattgacaatgtaaaattatcatatcctttgtggtga

SEQ ID NO: 34 - protein, 287 aa, Arabidopsis thaliana
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSEDAETEVVVSEFKRSERSAFSQLKSSVTEMNNMRGFMPYKKRVKVEENIDNVKLSYPLW

SEQ ID NO: 35 - DNA, 1098 bp, Arabidopsis thaliana
atgactcgtcgatgttctcactgcaatcacaatggccacaactctcggacttgtcccaatcgcggcgtgaagctctttggtgttcggctcaccgaaggttcgatccggaaaagtgcaagtatgggtaatcttagccattacacgggttctggatcgggtgggcatggaaccgggtccaacactccgggttctccgggtgatgtccctgaccatgtcgctggtgatggttacgcttctgaggatttcgttgctggctcttcctctagccgcgagagaaagaaaggaactccatggacagaggaagaacacaggatgttcttattaggtttacagaagctgggtaaaggtgattggagaggtatctcaagaaactatgtgaccactaggacacctacacaagttgctagccatgctcagaagtatttcatcagacaatccaatgtctctcgtcgcaaaagacgttctagtctctttgatatggttcctgatgaggttggagatattcccatggatttgcaagaaccagaggaagataatattcctgtggaaactgaaatgcaaggtgctgactctattcatcagacacttgctcctagctcacttcacgcaccgtcaatcttggaaatcgaagaatgtgaatcaatggactccacaaactctaccaccggggaaccaaccgcaactgccgctgctgcttcttcttcttccagactagaagaaaccacacaactgcaatcacaactgcaaccgcagccgcaactacctggctcattccccatactatatccgacctacttttcaccatattacccgtttccattcccaatatggcctgctggttatgttcctgaaccacccaagaaagaggaaactcatgaaattctcagaccaactgctgtgcactcgaaagctcctatcaatgttgacgagcttcttggtatgtctaagctcagccttgcagagtccaacaaacatggagaatccgatcagtctctttcattgaagctaggtggcgggtcatcttcaagacaatcagcatttcacccgaatcctagctctgatagttcagacatcaaaagcgtgatacacgctttataa

SEQ ID NO: 36 - protein, 365 aa, Arabidopsis thaliana
MTRRCSHCNHNGHNSRTCPNRGVKLFGVRLTEGSIRKSASMGNLSHYTGSGSGGHGTGSNTPGSPGDVPDHVAGDGYASEDFVAGSSSSRERKKGTPWTEEEHRMFLLGLQKLGKGDWRGISRNYVTTRTPTQVASHAQKYFIRQSNVSRRKRRSSLFDMVPDEVGDIPMDLQEPEEDNIPVETEMQGADSIHQTLAPSSLHAPSILEIEECESMDSTNSTTGEPTATAAAASSSSRLEETTQLQSQLQPQPQLPGSFPILYPTYFSPYYPFPFPIWPAGYVPEPPKKEETHEILRPTAVHSKAPINVDELLGMSKLSLAESNKHGESDQSLSLKLGGGSSSRQSAFHPNPSSDSSDIKSVIHAL

SEQ ID NO: 37 - DNA, 702 bp, Arabidopsis thaliana
atgggcagaagatgctcacactgtggaaacgtaggacataactcaagaacatgttcttcttaccaaacaagagtagttaggctctttggtgttcatctagacaccacaagctcttctccgccgcctcctcctcctccctcgattttggccgctgcaataaagaaaagtttcagcatggattgcttgccggcatgttcctcctcttcctcttcctttgctggttatctctccgatggtctcgcccataaaacacctgaccgcaaaaaaggggttccatggacggcggaagagcaccggacgtttctaattggattagaaaagcttggaaaaggagattggagaggaatctctagaaacttcgtcgtcacaaaatccccgacacaagtggcaagtcatgctcaaaaatactttctccggcaaactaccactctccatcacaagagacgccgcaccagcctctttgatatggtttcggccggcaatgttgaagaaaatagtactactaagaggatatgtaatgatcatattgggtcgagctcaaaggttgtttggaaacaaggattactcaatcctcgtcttggatatccagatccgaaagtatcagtatccggctcgggtaactccggtggactcgatcttgagctgaagcttgcgtccattcaatctcctgaatcgaatattagacctattagcgttacgtga

SEQ ID NO: 38 - protein, 233 aa, Arabidopsis thaliana
MGRRCSHCGNVGHNSRTCSSYQTRVVRLFGVHLDTTSSSPPPPPPPSILAAAIKKSFSMDCLPACSSSSSSFAGYLSDGLAHKTPDRKKGVPWTAEEHRTFLIGLEKLGKGDWRGISRNFVVTKSPTQVASHAQKYFLRQTTTLHHKRRRTSLFDMVSAGNVEENSTTKRICNDHIGSSSKVVWKQGLLNPRLGYPDPKVSVSGSGNSGGLDLELKLASIQSPESNIRPISVT

SEQ ID NO: 39 - DNA, 954 bp, Arabidopsis thaliana
atggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatga

SEQ ID NO: 40 - protein, 317 aa, Arabidopsis thaliana
MVKETVTVAKTCSHCGHNGHNARTCLNGVNKASVKLFGVNISSDPIRPPEVTALRKSLSLGNLDALLANDESNGSGDPIAAVDDTGYHSDGQIHSKKGKTAHEKKKGKPWTEEEHRNFLIGLNKLGKGDWRGIAKSFVSTRTPTQVASHAQKYFIRLNVNDKRKRRASLFDISLEDQKEKERNSQDASTKTPPKQPITGIQQPVVQGHTQTEISNRFQNLSMEYMPIYQPIPPYYNFPPIMYHPNYPMYYANPQVPVRFVHPSGIPVPRHIPIGLPLSQPSEASNMTNKDGLDLHIGLPPQATGASDLTGHGVIHVK

SEQ ID NO: 41 - DNA, 921 bp, Oryza sativa
atggataggaacacgaacaacaacagcaacagcagcagcagcagcgagatgccggggaagaaggccaggaagccgtacaccatcacgaagccacgggagagatggagcgaggaggagcacgagaggttcctcgacgcgctcatcatgtacggccgcgactggaagaagatcgaggagcacgtcggcaccaagaccaccatacagatccgcagccacgcgcagaagtacttcctcaaggtgcagaagatggggctcgccgccgggctgccgccgcagtacccgaggcggaggctcgtcatgcagcagcagcagcagcagagctcgccggcggtgagcagctcggtggcggcgacggcgatcctccacgggcagccgcagtgcttgccgccgcatcacaacgtcgctgttcagagctccatcggttgggagtgtcccggagttcttcctcctgcaaccaatgacatgcagaacttggaatgggcaagtacttcaggcactgcagcctgggggaaccatcacggcctgattgaaccaccagcagcatttgtttcatttcctggtgaaagttcattcatgggggcagcaagtttcagtaatacgagcatggactggactggcaccacaagtgaaatggcaacagccagcattgtgcaggatgaaacgatcgagcttccactatcacctgatgatctgcaatttgcacaagtatacaggttcatcggcgacattttcgatccagactcgccgtgtccagtggaaacacaccttcagaaactgaagagcatggatgatatcatcgtgaagacgatactgttggtgctaagaaatctcgaagacaacctgttatcccctcagtttgagcctattagaaggttgctgtcgacgtatgatccgaaccgaggactgtctggccatttgtag

SEQ ID NO: 42 - protein, 306 aa, Oryza sativa
MDRNTNNNSNSSSSSEMPGKKARKPYTITKPRERWSEEEHERFLDALIMYGRDWKKIEEHVGTKTTIQIRSHAQKYFLKVQKMGLAAGLPPQYPRRRLVMQQQQQQSSPAVSSSVAATAILHGQPQCLPPHHNVAVQSSIGWECPGVLPPATNDMQNLEWASTSGTAAWGNHHGLIEPPAAFVSFPGESSFMGAASFSNTSMDWTGTTSEMATASIVQDETIELPLSPDDLQFAQVYRFIGDIFDPDSPCPVETHLQKLKSMDDIIVKTILLVLRNLEDNLLSPQFEPIRRLLSTYDPNRGLSGHL

SEQ ID NO: 43 - DNA, 1101 bp, Oryza sativa
atgacgaggcggtgctcgcactgcagcaacaacggccacaacgcgcggacctgccccgcccgcggcggcggtggaggcggaggcggggtgaggctgttcggcgtgcggctcacgtcgccgccggaggtggcgatgaagaagagcgcgagcatgagctgcatcgcgtcgtcgctcgggagtggcggtgggtcagggggttcgtcgccggcgggaacgggaaggggaggaggaggagggggagagggcgcggccgggtacgcgtccgacgaccccacgcacgcctcctgctcgacgaatggccgcggcgagcggaagaaaggtacaccttggactgaagaagagcatagaatgtttctaatgggtctgcagaagcttggtaaaggagactggcgtgggatctctcgtaattttgttgtttccaggacaccaactcaggtggctagccatgctcaaaagtacttcattagacagacaaactcatcaagaaggaagaggaggtcaagcttgtttgacatggtcccagaaatgcccatggacgaatccccagtggtcgtagaacagcttatgctccatagtactcaagacgaagccacaagctcaaatcaattgccaatatcacatcttgtgaaacagaaggaacctgagtttgctagacacctgtcggatttgcagctaaggaagcatgaggaatctgagttcacagaaccttcactagcagcactagacttggagatgaaccatgctgcacctttcaagactaaatttgttctgacaatgccaacattctacccggcattaatacctgttccactaactctttggcctccaaatgttgctaatgtgggtgaatcaggcacaaatcatgaaatcctaaagcccactccagtgaatggaaaggaggtgatcaataaggctgatgaggttgttggcatgtccaagcttaccataggtgacggcagctctaactccatagaaccctctgctctttcccttcagcttactggaccgacaaatacaagacaatcagcttttcatgtgaacccaccaatggctggacctgacctaaataagagaaacaacagcccaattcatgcagtttga

SEQ ID NO: 44 - protein, 366 aa, Oryza sativa
MTRRCSHCSNNGHNARTCPARGGGGGGGGVRLFGVRLTSPPEVAMKKSASMSCIASSLGSGGGSGGSSPAGTGRGGGGGGEGAAGYASDDPTHASCSTNGRGERKKGTPWTEEEHRMFLMGLQKLGKGDWRGISRNFVVSRTPTQVASHAQKYFIRQTNSSRRKRRSSLFDMVPEMPMDESPVVVEQLMLHSTQDEATSSNQLPISHLVKQKEPEFARHLSDLQLRKHEESEFTEPSLAALDLEMNHAAPFKTKFVLTMPTFYPALIPVPLTLWPPNVANVGESGTNHEILKPTPVNGKEVINKADEVVGMSKLTIGDGSSNSIEPSALSLQLTGPTNTRQSAFHVNPPMAGPDLNKRNNSPIHAV

SEQ ID NO: 45 - DNA, 933 bp, Oryza sativa
atggccaggaaatgctccagctgcgggaacaatggccacaactccaggacttgcaccggccaaaggagcctgcaggagagtggcggcggttatggcggcggtggcgccggtggcgtgaggttgttcggggtgcagttgcacgtcggcggtgcgcctctgaagaagtgcttcagcatggagtgcctatcgtcgccgtcgccgtcgccgtcgccggcgtactacgccgcggtcgccgccgccgcctccaactcgtcgccgaccgtgtcgtcgtcgtcgtcgctggtgtcggtggaggaggccggcgagaagatggccaacgggtacctctccgatggcctcatggcgagagctcaggagaggaagaagggtgttccatggactgaagaggagcacaggaaattcctggtagggctcgagaagctcgggaaaggcgactggcgcggcatttcccggcacttcgtcacgacaagaacaccgacgcaggtggccagccatgcccagaagtatttcctcaggcagagcagcctcacgcagaagaagagaagatccagcctctttgacgtgattgaggatgcagaaaaggctccgagtgtgaatgaacgtctgaaactgagacacgagacagcctctgtgcctgctgaaatgggattccctgcactgtcactgggtatcagcagcatggcacagccagaagccatgctgctgcctcctccatccttaaccctgacgccaagctgttcatcaccagcagtgagcagcagcagcagcgaacaaccaagaacaatccatccttctctgatggtggcaaagcctcaggtgcaactgcaactccagccacctgatctggagctcaagatctcgactgtccgtcagaacgatcagcccagttcgtcgccgaggacgccttttttggggacaatcagggtcacttga

SEQ ID NO: 46 - protein, 310 aa, Oryza sativa
MARKCSSCGNNGHNSRTCTGQRSLQESGGGYGGGGAGGVRLFGVQLHVGGAPLKKCFSMECLSSPSPSPSPAYYAAVAAAASNSSPTVSSSSSLVSVEEAGEKMANGYLSDGLMARAQERKKGVPWTEEEHRKFLVGLEKLGKGDWRGISRHFVTTRTPTQVASHAQKYFLRQSSLTQKKRRSSLFDVIEDAEKAPSVNERLKLRHETASVPAEMGFPALSLGISSMAQPEAMLLPPPSLTLTPSCSSPAVSSSSSEQPRTIHPSLMVAKPQVQLQLQPPDLELKISTVRQNDQPSSSPRTPFLGTIRVT

SEQ ID NO: 47 - DNA, 906 bp, Oryza sativa
atggcgaggaagtgctcctactgtggcaactacggccacaactcaagaacctgcagcagcagcgccagcgctggacacagggataccaccatgctctgcgacggcggcgacggaggtggcggcagtgggctgaggctgttcggagtgcaggtccatgtcgctgccggcggcggcggtggaggtggaggtggaggtttgccgatgaagaagagctacagcatggactgcctgcagctggcggcggcgggggcggctccgggctcgctcgtgtcgccgtcgtcgtcgtcctcgtcgtcgatgctcctgtcgatcgacgaggggggcttggagagggcgtccaatgggtacctgtctgatggcccccatggcagaattgtccaggagaggaagaaaggagttccgtggagcgaggaggagcaccggctgttcctcgtcgggctcgagaagctgggcaagggcgactggcgaggcatctcccggagctacgtcacgacgaggaccccgacccaggtcgccagccacgcccagaagttcttcctcaggcagagcagcatcggcaagaagaagcgccgctccagcctcttcgacatggtgccgatttgcgagaacggtgcgcgcgtctcggagcagctgagcggcgaaggcgcggcggcggcggcggcggcgtcgacctcactgtcgctgatgaacacgcacgagacctcctcggacagagtggcggcaattgatctgaattccaccgaggaagatgacacggtgggcgcgtcagggaggccgtttttcccggtggttctgatggagcagcagcagcaggcttcccatggacatggtcaccaccaccactgcacgccgctcgacctggagctcggcatgtccgtctcgtcgacgccgtccatcggcacatga

SEQ ID NO: 48 - protein, 301 aa, Oryza sativa
MARKCSYCGNYGHNSRTCSSSASAGHRDTTMLCDGGDGGGGSGLRLFGVQVHVAAGGGGGGGGGGLPMKKSYSMDCLQLAAAGAAPGSLVSPSSSSSSSMLLSIDEGGLERASNGYLSDGPHGRIVQERKKGVPWSEEEHRLFLVGLEKLGKGDWRGISRSYVTTRTPTQVASHAQKFFLRQSSIGKKKRRSSLFDMVPICENGARVSEQLSGEGAAAAAAASTSLSLMNTHETSSDRVAAIDLNSTEEDDTVGASGRPFFPVVLMEQQQQASHGHGHHHHCTPLDLELGMSVSSTPSIGT

SEQ ID NO: 49 - DNA, 831 bp, Oryza sativa
atgcctacagatgatgccacggcgacgggcaacggcgacggcgccgctccccgtccggcagccgccgagccagcggcgccgctgtcgtccgtgtggacgcggcgggacgaaaagctgctggagatgctgctctggcgctggcagctggacccgcactgggaccggctcgccgcggagctcggcggcaagacggcgacgcaggtgttcgaccggtacgtgtgcttggccgacgagctgaggctcgtcatggcggcgccggcggtggacacgccgcccgcgtgggacgtgcaggacgaacgggaggccgctgtggcgccactacccgggttggaggccgacgcggcggccggcgccggagagtcagcggaggtgacggccattggcatcgctgccgccgcttctccgaatgcagctgctacgagcgctccgaccatcggcggcggggtggtattgaaatctagagagctgaaaaatccgcggaagacgaggatggccggcggcgggccaaggaagaaggcggagatgtggaccagggaagagcatagccaattcttgcacgggattagtacgtacgggaaggggaattggaaggcgctggcgagcgagttcgtgaagaccaagagctcgacccagatcgcgagccactaccagaagttctgcatcagggaagagaagaggaggctgagcaagtgcaagcgggcgagcatccacgacatcgtcagcccgacgacgacgacgtccgcgcctgaatctgccggcgccggcccgagtgcaccaccgtgcgcgctgatcgaaagcggtgcgctgattgcaggcgacgatgacgcatga

SEQ ID NO: 50 - protein, 276 aa, Oryza sativa
MPTDDATATGNGDGAAPRPAAAEPAAPLSSVWTRRDEKLLEMLLWRWQLDPHWDRLAAELGGKTATQVFDRYVCLADELRLVMAAPAVDTPPAWDVQDEREAAVAPLPGLEADAAAGAGESAEVTAIGIAAAASPNAAATSAPTIGGGVVLKSRELKNPRKTRMAGGGPRKKAEMWTREEHSQFLHGISTYGKGNWKALASEFVKTKSSTQIASHYQKFCIREEKRRLSKCKRASIHDIVSPTTTTSAPESAGAGPSAPPCALIESGALIAGDDDA

SEQ ID NO: 51 - DNA, 741 bp, Oryza sativa
atggcggcaatggcggcggcggcggcggggacgaagaagaaggcgaggaagccgtacacgatcacgaggccgcgggagaggtggtccgccgaggagcacgagcgcttccttgacgccctgattctgttcggccgtgactggaagaggatcgaagcgttcgtcgccaccaagacggccatccagattcgcagccatgcccagaagcattttctgaaggcccgcaagttcggcctcgccggtgggctcccgccgccgcttcaccctcgccgtgccacgctgctccgggccaacgccgcggcggcggacatgatgccgcccccgtggctgccatcggccggcggcggctccatcggttgctcggcgccaccgtccggcgtgcagcagagcatggccggcaggtcgccggcgtgctactcaactgatgaagcttctttccggccattgattcatagcaatgacaatgactgttcattcatcgagacaccaagctgcatcggatcaggtggcgaatcatggatcggtgatgatgccttcttcatgcaggatgaaacaattcggctcccaatttctccagatgacctgggattcgctcaggtgtacaagttcgtcggcgacatgttcggctccggcgagcggcggccggtggaggctcacctgcggaggctgcagggcatggaccctgccatctcggagacgatcttgctggtgcttaagaatctcgaagctaatctatctgcttaa

SEQ ID NO: 52 - protein, 246 aa, Oryza sativa
MAAMAAAAAGTKKKARKPYTITRPRERWSAEEHERFLDALILFGRDWKRIEAFVATKTAIQIRSHAQKHFLKARKFGLAGGLPPPLHPRRATLLRANAAAADMMPPPWLPSAGGGSIGCSAPPSGVQQSMAGRSPACYSTDEASFRPLIHSNDNDCSFIETPSCIGSGGESWIGDDAFFMQDETIRLPISPDDLGFAQVYKFVGDMFGSGERRPVEAHLRRLQGMDPAISETILLVLKNLEANLSA

SEQ ID NO: 53 - DNA, 864 bp, Oryza sativa
atggctaggaagtgctctagctgtgggaacaatggccacaactccaggacttgcagtggccaaagagttcttgatcacagcatcagcagcagcaacagtggtagtactactgctgctgctgctactgcctgtggtggcttgaggttgtttggggtgcagctgcaggtaggaggaggctcatctcctctgaagaagtgcctcagcatggagtgcttggcatcaccagcatactatggagcttctgcctcgccgtcggtttcgtcgtcgtcatcttcgcttgtttcgattgaggagaacactgagagggtctccaatgggtacctctctgatgggctcatgggaagggttcaggagaggaagaaaggagttccatggactgaggaagaacaccagatgttcctcgccggccttgacaagctcggaaaaggcgactggcggggcatttctcggcacttcgtcactacccggactccaacgcaggtcgccagccatgcccagaagtacttcctgaggcagaacagtatgacacagaagaagaggaggtccagcctctttgatgtggttgaaggtatcaagagggcagcagcaatgcccatttcaggatctgcatctgaactgcagatccccggcatgtcgatcggtgtcggcgtggtgaaggaggaggttgtcctgcctccatgtctgaacctgatgagtaacagttcatcagcatcacagcactcaccttccctgacattgctggcaaatcctcaggtgcagctccagatgcctgacctggagctaaagatgtccacatcccggttatctgaccaatccggtccgtcgccgagcacgcctttcttcgggaccatcagagttacctga

SEQ ID NO: 54 - protein, 287 aa, Oryza sativa
MARKCSSCGNNGHNSRTCSGQRVLDHSISSSNSGSTTAAAATACGGLRLFGVQLQVGGGSSPLKKCLSMECLASPAYYGASASPSVSSSSSSLVSIEENTERVSNGYLSDGLMGRVQERKKGVPWTEEEHQMFLAGLDKLGKGDWRGISRHFVTTRTPTQVASHAQKYFLRQNSMTQKKRRSSLFDVVEGIKRAAAMPISGSASELQIPGMSIGVGVVKEEVVLPPCLNLMSNSSSASQHSPSLTLLANPQVQLQMPDLELKMSTSRLSDQSGPSPSTPFFGTIRVT

SEQ ID NO: 55 - DNA, 813 bp, Oryza sativa
atgcacgccatcatggcgaggcgatgctctggtgactactcgactgcaggccaacgagccggcgaggagggcggcggcggcggcggcgccgggctacggctgttcggggtgcagctccatgctgcggcggccagctcgccggcgtcctacttgcacaagagttacagcatggattgcctgcggctgcaggtttcttctccttcctccttgcagtcgtcgtcgtcgtcgccgtcgccgttgacgtcctcgttgttgctgtccatcgacgagggctgcgagaggccagccgccgacggctacctctccgacgggcctcacggcgcggcggcaaccatgcgggagaggaagaaaggagttccatggagcgagcaagagcacaggctgttcctggcggggctggagaagctgggcaagggcgactggcgaggcatctcccggagcttcgtcaccaccaggacgcccacccaggtcgccagccatgcccagaagttcttcctccgccacaacagcgccgccaagaagaccaacaacaagcgccgctccagcctcttcgacatggttcaggattgtgacagtggaggaagatctctcgcctcatccgatcctgccactcgctgcaacaacaacatctctgcttctctgtctctccaagtttcgcaccacaaatcaggtgacagtgcgtggccttcgtcagaaacaccatcagtttcagaagcacaacaaggtcatggatacggcactagtcaccattgctctccgctggacctggagctgggcatgtccctgtccaccacgccatccatcggaacctag

SEQ ID NO: 56 - protein, 270 aa, Oryza sativa
MHAIMARRCSGDYSTAGQRAGEEGGGGGGAGLRLFGVQLHAAAASSPASYLHKSYSMDCLRLQVSSPSSLQSSSSSPSPLTSSLLLSIDEGCERPAADGYLSDGPHGAAATMRERKKGVPWSEQEHRLFLAGLEKLGKGDWRGISRSFVTTRTPTQVASHAQKFFLRHNSAAKKTNNKRRSSLFDMVQDCDSGGRSLASSDPATRCNNNISASLSLQVSHHKSGDSAWPSSETPSVSEAQQGHGYGTSHHCSPLDLELGMSLSTTPSIGT

SEQ ID NO: 57 - DNA, 966 bp, Oryza sativa
atgggttcaatagtcattgaggggtggacggcatctgagatagaggaggctaggtcactgatcactagccccaacaacggtggcgaaggtggtgatggagaggggaacaagcagaagcattgcggacacatcgtgatggaactccatgaatggttcccttggaagaccataggccaggtaataggtttgtatatgaagctcaatgcggggaaacccatggttatgcatagcttgaataagagtgatgccaacaatagcatcggtgaggttgatcatgtgagtgccctcgcaaacggtaaccctgtgaggctagaggaacatcgacccatgttgaacaatgtgggcttagtgtttgattatccattggaagagatggagatggaaaatcaaacagatcaagagccgaagatggttgtagaggaggaggtgcagcctaaggagggattagtgatcaaggagaaagaggcgggggtgtcaaagattcacactaatagtcaacatgtgacgccatcaataaaaagaagggtgatttggacagaggaagaacacaggctgttcatggtggggctgcgcgtgttcgggcgcggcgactggaagaacatctccaagcaccttgtcaccaccaggacggcggcgcaggtctccagccacgcgcagaagttcttcctcaagatggaggcccgcggcgaggccgtccccccgccggccaagaggcgccgccgccgcatcaccggcgaccagcaggcggcggccgccgagcacgctgccgccctcaggcgccgcatgccagtgccaccgcctccgttcaaccccttcctcctgcccagcctcgtcgcgccggtgatgcaccgcctcctcccacctgggagccaggctgccggcgccgccgcctccggcagcggcggccagggagcttctcttcctcagatgccatggatcaacggcgccaatggcatggggcgctag

SEQ ID NO: 58 - protein, 321 aa, Oryza sativa
MGSIVIEGWTASEIEEARSLITSPNNGGEGGDGEGNKQKHCGHIVMELHEWFPWKTIGQVIGLYMKLNAGKPMVMHSLNKSDANNSIGEVDHVSALANGNPVRLEEHRPMLNNVGLVFDYPLEEMEMENQTDQEPKMVVEEEVQPKEGLVIKEKEAGVSKIHTNSQHVTPSIKRRVIWTEEEHRLFMVGLRVFGRGDWKNISKHLVTTRTAAQVSSHAQKFFLKMEARGEAVPPPAKRRRRRITGDQQAAAAEHAAALRRRMPVPPPPFNPFLLPSLVAPVMHRLLPPGSQAAGAAASGSGGQGASLPQMPWINGANGMGR

SEQ ID NO: 59 - DNA, 1185 bp, Oryza sativa
atggagtggacggcggcggagatggacgaggcgaggtcgatcatcgctaggctgaccaacgcttacgactccggcaccctcgttgccggcgccggcaacggcgacacgaggcacgaccgcattgtgagggagctgcaggcgtggctcccatggaggaccatggatcagctaatcgggctgtacattgagctcatggcggaggagcccgcggcggcgcagccgcagtacttcgacgccggcgccgtcgtcgaccctacgttcgacttcttcaacgaccacaacaacttcctcggcatgccgccgccgccggttcaacaagctgatgaccataacatgaacaacgtcgtcgccgacgccggcatgaactactactatggcggcggcggcgccggcggtgccatggtgtttggtggtgcacccatgggggagacggtggagcaggcagctccgccggtgccggtggtgccggtggtgatgaaccgcgacgacgacgaggtgaacaaccagggcggcggccgtcaccgtgctgcaccaacaaatactactaggaggttttggaccactgaagagcacaggcagtttctgagggggctgcgtgtgtacggacgtggtgagtggaagagcatctccatgaacttcgtcagaagcaagacgccggtgcaggtgtccagccacgcccagaagtacttccgccgcgtggagagcgccgccgccgacaagcagcgctacagcatcaacgacgtcggcctcaacgacgacaccgccgccatggacggcaccaacagctacagcaacaataacttcggtggctggcagagtctcgccttcgccggcggccacctcgagcccgtcagcggcggcggcgccgccaggcaagtcatcgctccggcgagctcctccgccgctgccatgaacagcgccgctcagttctgggctcctatgctgttcaacccccagattcagcagcagttcatgcagatgcaggcgcagacgcagcaggcgtggaatgatcagcatatgatgatggctgctgctccaatggagggagcaactgatactaactttgagcctgcaggtgcagttaattattattattatcaacagcagcaggaggaggaggagggaggtgcttatggtgttcctgcggatcagtggatgatgaaccagaacaacaacatgtgctga

SEQ ID NO: 60 - protein, 394 aa, Oryza sativa
MEWTAAEMDEARSIIARLTNAYDSGTLVAGAGNGDTRHDRIVRELQAWLPWRTMDQLIGLYIELMAEEPAAAQPQYFDAGAVVDPTFDFFNDHNNFLGMPPPPVQQADDHNMNNVVADAGMNYYYGGGGAGGAMVFGGAPMGETVEQAAPPVPVVPVVMNRDDDEVNNQGGGRHRAAPTNTTRRFWTTEEHRQFLRGLRVYGRGEWKSISMNFVRSKTPVQVSSHAQKYFRRVESAAADKQRYSINDVGLNDDTAAMDGTNSYSNNNFGGWQSLAFAGGHLEPVSGGGAARQVIAPASSSAAAMNSAAQFWAPMLFNPQIQQQFMQMQAQTQQAWNDQHMMMAAAPMEGATDTNFEPAGAVNYYYYQQQQEEEEGGAYGVPADQWMMNQNNNMC

SEQ ID NO: 61 - DNA, 897 bp, Oryza sativa
atggagtggacggcggcagagctggcggaggcaaggtcggtcatcgctagggtcagcgacgcctacaactccggcgtaggcagcagcagcagcgcctgcgacaccaagcacgaccgcattatgagggagctccaggcgaggttcccgtcgaggaccatggtccaggtaatcgatctgtacgttaatctcacggtggagacggcggcgcagccgcaggacgccggcagcgccggcgacgccgccgccgtcgtccaccctacttttgccggcggcatgcccgttgtgaacaacaacgacggcatggtgcatggtggtgctgctatggaggtgggggcggtggcggtgaacggcggggacggtgaggtggtgaacccggacaatgctgatgacgatgtgctttggactgattatgagcacaggctgtttctgactgggatgcgtgtgtacgggcgtggcgactggagaaacatctcgaggtacttcgtcagaagcaagacgccggagcagatctccatgtacgccgacaactacttccacatgatggagatcgccgcggccatggaagccgacggcggcgacgacgacgacggccaccatgaaatcaataacaacaacaacaacttgggcggcggccagctgcacgccgtcgtcggcgccgtcgggcacggccccggtgccgggcacattgctccggcgaccccctccaacaacaacaccgccgccgccgccgtgaacaacaacgtcgacacaccgttctgggttccgctgctgtacaaccccgagatagagcagcggatgatggagatgcaggcgcagtcgcagaaggcctgggatgatcagcagatgaagatggctgaagctgcaactccaaaggaggagggagcagctgataagtga

SEQ ID NO: 62 - protein, 298 aa, Oryza sativa
MEWTAAELAEARSVIARVSDAYNSGVGSSSSACDTKHDRIMRELQARFPSRTMVQVIDLYVNLTVETAAQPQDAGSAGDAAAVVHPTFAGGMPVVNNNDGMVHGGAAMEVGAVAVNGGDGEVVNPDNADDDVLWTDYEHRLFLTGMRVYGRGDWRNISRYFVRSKTPEQISMYADNYFHMMEIAAAMEADGGDDDDGHHEINNNNNNLGGGQLHAVVGAVGHGPGAGHIAPATPSNNNTAAAAVNNNVDTPFWVPLLYNPEIEQRMMEMQAQSQKAWDDQQMKMAEAATPKEEGAADK

SEQ ID NO: 63 - DNA, 1089 bp, Oryza sativa
atgctgctctctcattgttttgcagtagcattcgctctctctgcgctgctcgccggcctcgccctcgccatggacgacgcaacgttcggcatggagtggacggcggcggagctgggtgaggcgaggtcggtcatcgctagggtcagcaacgcctacgactccggcgccggcagcagcaacagtgccggcgacaccaagcacgaccgcattatgagggagctccaggcgaggttcccgtcgaggaccatggtccaggtaatcgacttgtaccttaatctcacggcggagacagcagcgcaggcgggggcggcccagccgcaggacgccggcggcgccggcgacgccgccgtcgtccaccctacctttggcctcgcgaacgacaacttcggcatgcccgttgcgaacaacaacgacgacggcgtcgacgccggcatggtgtttggtggagctcctatggaggagggggcggtggcggtgaacggtggggacggtgaggtggtgaacccggacaatgctgatgacgatgtgctttggaccgattatgagcacaggctgttcctgactgggatgcgtgtgtacgggcgtggcgactggagaaacatcgcgaggtacttcgtcggaagcaagacgccggagcaggtctccatgtacgccgataactacttccacatgatggagatcgccgcggccatggaagccgacggcgacgacgatgacgaccaccatgaaaacaataacaacaacttgggcggcgggcagctgcacgccgtcgtcggcgccgtcgagcaccatgaaaattacaacaacaacaacttaggcggcgggcagctgaacgccggcctcggcgccgtcgggcacggccccggtgccgggcacattgctccggcgacctcctccaacaacaacgtcgccgccgccgccgcgaacaacaacgtcgacgcaccgttctgggttccgctgctgtacaacctcgagatagagcagcgcatgatggagatgcaggcgcagtcgcagaaggcctgggatgatcagcagatgaagatggctgaagctgcaactgatccaaaggagggagcagctgataagtga

SEQ ID NO: 64 - protein, 362 aa, Oryza sativa
MLLSHCFAVAFALSALLAGLALAMDDATFGMEWTAAELGEARSVIARVSNAYDSGAGSSNSAGDTKHDRIMRELQARFPSRTMVQVIDLYLNLTAETAAQAGAAQPQDAGGAGDAAVVHPTFGLANDNFGMPVANNNDDGVDAGMVFGGAPMEEGAVAVNGGDGEVVNPDNADDDVLWTDYEHRLFLTGMRVYGRGDWRNIARYFVGSKTPEQVSMYADNYFHMMEIAAAMEADGDDDDDHHENNNNNLGGGQLHAVVGAVEHHENYNNNNLGGGQLNAGLGAVGHGPGAGHIAPATSSNNNVAAAAANNNVDAPFWVPLLYNLEIEQRMMEMQAQSQKAWDDQQMKMAEAATDPKEGAADK

SEQ ID NO: 65 - DNA, 501 bp, Oryza sativa
atgtccatggatacatctcctgtcatcagaaatacaaatgccagtgctgtagtaccctcctgggacaattctattgctcaacctttaagtgcaagtcgcacgcaaggtacaggtgctgttgctacaaataactgctctagtagcatagagagtccttctactacttggccaacttctgaagcagttgaacaagaaaatatgcttcgaccactacgtgctatgccagattttgcacaagtatacagctttctgggaagcatatttgatccagatactagtgggcatttgcagactttaaaggcgatggatccaattgatgttgaaacggtactactgctgatgagaaatctgtccatgaacttaactagccccaactttgcggcacatctgagcttgctgtcatcatgtaattctggtggggacccaattaagtctgaaggcatggaaaatcttggatctccacagagttgccatctcccgttcatggtaacaagtgagtga

SEQ ID NO: 66 - protein, 166 aa, Oryza sativa
MSMDTSPVIRNTNASAVVPSWDNSIAQPLSASRTQGTGAVATNNCSSSIESPSTTWPTSEAVEQENMLRPLRAMPDFAQVYSFLGSIFDPDTSGHLQTLKAMDPIDVETVLLLMRNLSMNLTSPNFAAHLSLLSSCNSGGDPIKSEGMENLGSPQSCHLPFMVTSE

SEQ ID NO: 67 - DNA, 1152 bp, Oryza sativa
atgacgcgtgacggcgcgctgccggcgagcggcggcggcggggcggcggaggggccgaggcggtgctcgcagtgcgggcaccacgggcacaacgcgcggacgtgcacggcgaggggccccgtgaagctgttcggcgtgcggatcggcgacaagccgccgaccgcggccgcgggcggaggaggagggatgaggaagagcgccagtatggggagcctcgcgcagctggcggaggggggcggcggcggcggcgggagggaggaggggtacggctccgatgggaacgacgacaaacggcggaagcgaggtgaggcatggtcagaagaggagcacaaaaagtttctacttgggcttagtaagttaggaaaaggtgattggcgcggcatatcacgcaattatgttggttcaaggacgcctactcaagttgctagccatgctcaaaagtacttcattcgccaaacaaatgtgcacaggagaaaaagaagatcaagccttttcgatatggttatagatgattctgatgaccaaccactgtcccgtacatcttcacaagaagtagaagtagaagagaatctagaagatggacatcctgttactgcaccagtgatcccacctgctcctgtgcctatgctatcatcctctttggttccgccaccagtaccagcaatggcaccagttgctccaggtcctgtgttaacatctgcttcggccacactaccagtgtcagcagtggcaccccaaaccgatgaaaaggaacaagttgcctcaggttcaaatacaacagagacaggggctgcaattccagaagtcatgcccccatatggttatccaatgatgcttcctccatactacccaccggcatttgttccaatgccctactatggttatgtgcctgttttctatgcaccaccaggagcagtgcaagcacaacatgaggttgtcaagcctgtggccgtgcactcaaaacctccagtgcacatcgatgaactctacagcatgtccgaactcagcctgaagggcgaggctggtgtgaaaaacggcactcctaattctctgttgcctccaagaccaattggtagaccagacaggcaatctgcttttcatggaaaaggaccttctgatggctcttcaaatggactgattcctgcaaagtga

SEQ ID NO: 68 - protein, 383 aa, Oryza sativa
MTRDGALPASGGGGAAEGPRRCSQCGHHGHNARTCTARGPVKLFGVRIGDKPPTAAAGGGGGMRKSASMGSLAQLAEGGGGGGGREEGYGSDGNDDKRRKRGEAWSEEEHKKFLLGLSKLGKGDWRGISRNYVGSRTPTQVASHAQKYFIRQTNVHRRKRRSSLFDMVIDDSDDQPLSRTSSQEVEVEENLEDGHPVTAPVIPPAPVPMLSSSLVPPPVPAMAPVAPGPVLTSASATLPVSAVAPQTDEKEQVASGSNTTETGAAIPEVMPPYGYPMMLPPYYPPAFVPMPYYGYVPVFYAPPGAVQAQHEVVKPVAVHSKPPVHIDELYSMSELSLKGEAGVKNGTPNSLLPPRPIGRPDRQSAFHGKGPSDGSSNGLIPAK

SEQ ID NO: 69 - DNA, 1020 bp, Oryza sativa
atgcctcaagattcgcgccccgccgcgatgcgcctcttcggcgtcaccatctcgccgccgccgccgccgccggagccggagccggagccggatccgtccgacccccgggatccgagcccgcggccggcgagggaggacgcgatgcgcaagtgcaagagcatgggcaacctcgccgccgccgccgccgcctcctccgccgcagccggcggcggcggcgccggggacgccgggggatcgggcgacgggtacctctccgacggtgggctgctgctgtcctccggcaagcggcggcgcgcgcaggagaggaagaaagctgtcccttggactgaagaagagcaccgaacatttcttgctggtcttgaaaagctaggaaagggggactggaggggtatatctaagaactttgttactaccaggactccaactcaagtggctagtcatgctcagaaatattttcttagacaaactaatccaaacaagaagaagcgcagatcaagcctttttgatatgatggcaactgatatgtcaccagcaccaaactgccctgtcttgccaccatcaatgggaaaattacatgatatggtagctatgactaaacaactccagaacagcagtttggaaggagtctcatcttcaagcacagttaatctagcaccacaagttgcaagagatcttcctcccccaattccatcttttaaagcaacaaatgtagattcaagtctcagcaaaatgaaccacatggacggtttcttgagggcgcccatgctgttcagaccaattccaagaatcgctgaaggggcatcttcatcgactcctgcaactgcaagcatagctgatctggaatttcaagctaacctgactgcatgttctaatgcattattcgcgagtccgagaagaaagccaaagaaggcagatcctccagcagagaaggatctggatctgacagttgccccaccctcccaacaaaccagggccagtatttcttcccagaacgcagtaggcgtaattcaagtcgtatag

SEQ ID NO: 70 - protein, 339 aa, Oryza sativa
MPQDSRPAAMRLFGVTISPPPPPPEPEPEPDPSDPRDPSPRPAREDAMRKCKSMGNLAAAAAASSAAAGGGGAGDAGGSGDGYLSDGGLLLSSGKRRRAQERKKAVPWTEEEHRTFLAGLEKLGKGDWRGISKNFVTTRTPTQVASHAQKYFLRQTNPNKKKRRSSLFDMMATDMSPAPNCPVLPPSMGKLHDMVAMTKQLQNSSLEGVSSSSTVNLAPQVARDLPPPIPSFKATNVDSSLSKMNHMDGFLRAPMLFRPIPRIAEGASSSTPATASIADLEFQANLTACSNALFASPRRKPKKADPPAEKDLDLTVAPPSQQTRASISSQNAVGVIQVV

SEQ ID NO: 71 - DNA, 2160 bp, Oryza sativa
atggagattaattcctctggtgaggaagcggtggtaaaggtgaggaagccatacacaatcacaaagcagagggagcgttggactgaggcagagcacaacaggttccttgaagccttgaaactgtatgggagagcctggcagcgcatagaagagcatgttgggacaaagacagctgtgcagatcagaagtcatgctcaaaagttcttcaccaagttggaaaaggaagctatcaacaatggcacttctccaggacaagctcatgacatcgacatacctccaccacgaccaaaaagaaaacctaacagtccatatcctcgaaaaagttgtctcagctctgagacatccaccagggaagttcaaaatgataaggcaacaatatcaaatatgacgaacaatagcactgcacaaatggcaggtgatgcagctcttgagaaacttcaaagaaaggagatatctgaaaaaggaagttgctccgaagttcttaatctctttcgagaagtcccatcggcatcattttcttcagttaacaaaagctcttcaaatcatggtgcatccagggggctggaaccgactaaaacagaagtcaaagatgtggtcatcttggaaagggattctatttccaatggtgcagggaaggatgcaaaagatatcaatgatcaagaaatggaaaggctcaatgggatacacatcagctcgaagcctgatcattctcatgaaaactgtttggatacctcaagccaacaatttaagccaaaatcaaactctgtggagacaacatatgtggattggtctgctgcaaaagcttcacactaccaaatggacagaaatggggttactggctttcaagccactggaactgaaggaagccatcctgatcaaacaagtgatcaaatgggaggagccagcggaactatgaatcaatgcatccatccaacacttcctgtggatccaaaattcgacggcaatgccgcagcacagccctttcctcacaactatgcagcctttgcaccaatgatgcaatgccactgcaaccaagatgcctacagatcttttgccaatatgtcatccaccttctccagcatgcttgtctccacattgttgtcaaaccctgcaatccatgcagctgccaggcttgcagcatcgtactggcctacagtagacggcaatactcctgatccaaatcaagaaaatctttctgagagtgctcaaggaagccacgctggctctcctcccaacatggcatctattgtcacagctacagttgctgcagcatcagcatggtgggcaacacaaggtcttctccctctttttcctccacctatagcttttccatttgttccagctcctagtgctcccttttccacagcagatgttcagcgagctcaagagaaagatatagactgcccaatggataatgcacagaaggaattgcaagaaactcggaaacaagataattttgaagctatgaaggtcatagtgtcttcagagactgatgagagtggaaaaggagaagtgtcgctccacactgagttaaagatatctccagcagataaggccgacaccaaacctgccgcaggagctgaaacaagtgacgtttttggaaataagaaaaagcaggatcgctcttcatgtggttccaacacaccgtcaagtagtgatatagaagcagataatgctcctgagaatcaagaaaaggctaacgacaaggcaaagcaagcatcttgcagtaactcttcagccggtgacaataaccaccgtagatttaggagcagtgcaagcacaagtgattcatggaaggaagtttctgaagagggtcgtctggcttttgatgcactgttcagtagagaaaggcttccccaaagcttttctcctccgcaagtagaaggatcaaaggagattagcaaggaggaagaagatgaagtaaccacggtgacggttgacctcaacaagaatgccgctattattgatcaagaactcgacacagcggatgagccaagagcttcctttcctaatgaattgtcaaacctgaagctgaaatctcgcaggaccggtttcaaaccatacaagaggtgctcagtggaagcgaaggagaacagggtaccggctagcgatgaggttggtaccaagaggattcgtcttgagagcgaagcatcgacatga

SEQ ID NO: 72 - protein, 719 aa, Oryza sativa
MEINSSGEEAVVKVRKPYTITKQRERWTEAEHNRFLEALKLYGRAWQRIEEHVGTKTAVQIRSHAQKFFTKLEKEAINNGTSPGQAHDIDIPPPRPKRKPNSPYPRKSCLSSETSTREVQNDKATISNMTNNSTAQMAGDAALEKLQRKEISEKGSCSEVLNLFREVPSASFSSVNKSSSNHGASRGLEPTKTEVKDVVILERDSISNGAGKDAKDINDQEMERLNGIHISSKPDHSHENCLDTSSQQFKPKSNSVETTYVDWSAAKASHYQMDRNGVTGFQATGTEGSHPDQTSDQMGGASGTMNQCIHPTLPVDPKFDGNAAAQPFPHNYAAFAPMMQCHCNQDAYRSFANMSSTFSSMLVSTLLSNPAIHAAARLAASYWPTVDGNTPDPNQENLSESAQGSHAGSPPNMASIVTATVAAASAWWATQGLLPLFPPPIAFPFVPAPSAPFSTADVQRAQEKDIDCPMDNAQKELQETRKQDNFEAMKVIVSSETDESGKGEVSLHTELKISPADKADTKPAAGAETSDVFGNKKKQDRSSCGSNTPSSSDIEADNAPENQEKANDKAKQASCSNSSAGDNNHRRFRSSASTSDSWKEVSEEGRLAFDALFSRERLPQSFSPPQVEGSKEISKEEEDEVTTVTVDLNKNAAIIDQELDTADEPRASFPNELSNLKLKSRRTGFKPYKRCSVEAKENRVPASDEVGTKRIRLESEAST

SEQ ID NO: 73 - DNA, 957 bp, Oryza sativa
atgacgaggcggtgctcgcactgcagccacaacgggcacaactcgcggacgtgccccaaccgcggggtcaagatcttcggggtgcgcctcaccgatggctccatccgcaagagcgccagcatggggaacctctccctcctctcctccgccgccggatccaccagcggcggcgcctcccccgccgacggccccgacgccgcccccaccgccgccgacggctacgcctccgacgacttcgtccagggctcctcctccgccacccgcgaccgcaagaagggtgttccttggactgaagaagaacaccggaggtttttgcttggattgcaaaagcttggcaaaggtgattggcgaggaatctctcgtaatttcgtggtctcaagaacacctactcaagtagccagtcatgctcagaaatattttatacgccaatccaatatgaccagaaggaaaagaaggtctagcctttttgacatggtgccagatgagtctatggaccttccaccacttcctggaggtcaagaaccagagacccaagtattaaatcaaccagcactacctccaccgagggaggaggaggaggtagattctatggagtcagatacttctgccgttgcagagagctcttccgcttctgctatcatgccagataatttgcagtcgacctatccagtgattgttccagcttatttctcgccctttttgcaattctcggttcctttctggcaaaatcagaaagatgaagatggtcctgtgcaagaaacacatgagattgtcaagcctgttccagttcattcaaagagcccaatcaacgttgatgagcttgttggcatgtcgaagctcagcataggagagtccaatcaagagacagtgtctacttctctttcattaaatctggtaggaggtcaaaatagacaatcagctttccatgcaaatccaccaacaagggcacaggcatga

SEQ ID NO: 74 - protein, 318 aa, Oryza sativa
MTRRCSHCSHNGHNSRTCPNRGVKIFGVRLTDGSIRKSASMGNLSLLSSAAGSTSGGASPADGPDAAPTAADGYASDDFVQGSSSATRDRKKGVPWTEEEHRRFLLGLQKLGKGDWRGISRNFVVSRTPTQVASHAQKYFIRQSNMTRRKRRSSLFDMVPDESMDLPPLPGGQEPETQVLNQPALPPPREEEEVDSMESDTSAVAESSSASAIMPDNLQSTYPVIVPAYFSPFLQFSVPFWQNQKDEDGPVQETHEIVKPVPVHSKSPINVDELVGMSKLSIGESNQETVSTSLSLNLVGGQNRQSAFHANPPTRAQA

SEQ ID NO: 75 - DNA, 798 bp, Oryza sativa
atggagcagcatgaggaggcagcggagaggaagccttcgccgccggtgatattccggctgttcggcgtcgaggtccgcggcggcggcggcggagttgacgaggaggagtacgaggaggaggaggtggagggtggattgttcatcaagaagagctccagtatgcccaacctcacctccatcgacccgctgccggtgccggccgacggcggcaaacggcgcgcctccgacgactccgagctcgcctccggccagcagaagcgccgccgccgcaaggtgcaggagaggaagaaaggggtaccatggactgaggaggagcacaagaaattcctggaagggctgaggcagctggggaaaggggactggagaggcatctccaagaactttgtgaccagcaggacggcgactcaggtggccagccacgcccagaagtacttcctccggcagaccaaccctggcaaaaagaagcgccgggccagcctctttgatgttgttgctgagtgcagtgatgatcagcttccaagtcctcagagtgttggaactaagcctcctacccaggatataattcatacagatcgcggcgatgtcccgatactaagctatccagttgctagaggctttagaggcgatagcgtgcaggttgatgaactaactgaatatgtgaagagattaaaggccgccgaggacatgtcgctctccatgatctctggactggaaatggcatcatcatccatcagcagtctagagctcagtatcgcgcctcctcattgcgcgatcgaggcggccatcaaggtgctgtga

SEQ ID NO: 76 - protein, 265 aa, Oryza sativa
MEQHEEAAERKPSPPVIFRLFGVEVRGGGGGVDEEEYEEEEVEGGLFIKKSSSMPNLTSIDPLPVPADGGKRRASDDSELASGQQKRRRRKVQERKKGVPWTEEEHKKFLEGLRQLGKGDWRGISKNFVTSRTATQVASHAQKYFLRQTNPGKKKRRASLFDVVAECSDDQLPSPQSVGTKPPTQDIIHTDRGDVPILSYPVARGFRGDSVQVDELTEYVKRLKAAEDMSLSMISGLEMASSSISSLELSIAPPHCAIEAAIKVL

SEQ ID NO: 77 - DNA, 1476 bp, Oryza sativa
atggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtga

SEQ ID NO: 78 - protein, 491 aa, Oryza sativa
MEMACLPGNAMATDENGADDRAGGESTVDHLRSHMNYGDMDLSGEEHVPKARKPYTITKQREKWTDEEHRLFLEALQLHGRAWRRIQEHIGTKTAVQIRSHAQKFFSKVVRESSGSNTGSGGASAAAAAAAIQIPPPRPKRKPAHPYPRKVDGAAKKHVPALRQLEKPPLWMQSLSEQEEGSPTSVLTAAQIGTEALGGGFSNNSSGSGSLAPSAAGTDEHVDGGGSPASSVDREDGCLSPSIPTAELAMQAPNTKMSIATTDAKEASSEASVFRLFGKSVVVKDSDQLHLLNGSNIATSGSVERATRNILVPSFAAAPEGSSSNPWPSSMQQFLYFLPRSDGFAAQPVMPWLSYNGSLPCALFYPAAAAAANQQCHRDSEGVEFRVSQREGSLTGSNTASSVVLGSSAAVPAAAAAAQNSDVAESRGQGNSREAAASPRLTKCESSASVTLLQRGFMPYKRCAAESELLRSEAAGGEEAVADGELTRLCL

SEQ ID NO: 79 - DNA, 1392 bp, Oryza sativa
atggcgcgttttcaggaaaccaaggcgaggaatgatcaaggacctgttgctgatcatgttgggcaccaaaacctcatggaaaacctcacagatcctctggattccagtggcatggacatgatggacgaagcgcgaattcctaaggcgcggaagccatacacgataacgaagcaaagggagaaatggaccgaggacgaacataagctgttcttggaagccctgcagctccatggccgagcctggcgacgcatccaagagcacataggcaccaagactgccgtgcagatcaggagccacgcacagaagttcttctccaaggtcatcaaagaatcatctggggacaattgcaacagcttgggtgctgcatcatcaattcagattcccccgccgcggccgaagcgtaagcctgttcatccgtacccacgcaatctagggagcacagccagcaagaacgtccctgcactgaaacagctagagaagcctcagctgcaggtgcagtctctctacgaccaggacaatgggtcgccgacgtcagtgttaacagtaccacagatacgggctgatacactgggaagtgagagtggtgggtcgccaacctcgacgattgatattgaagagagatgtcctacaccaagcatagcaactgctgagttagctatggagttgcctcctacaaatgacgaggaggtcaagggcaatggcgatcatgaagaagttacatgtgacagatcaggagttccagtccttaggctatttggcaagagggttatggtgaatgatttacatcagatgtcagcccctgatgccgggaacctgcaaactgtggcagacatggaagtggacgcttcagctgagacaccaactagtggaactgggaaattctcttcccatggtgcagcagaagcaaatacatggaacccatggctgactaacacacagcagtttctgtattatcttcctaacggacaaattttctccgtgcattctgctctcccatgcttcacctaccataatgagggtgttacttgcacccagttttcaaacccacaggtggtagcctcagatcaacagcatcaacaccaaacttctgaagctgtagattacaagggtatacagagggaaggatcttggacggagtcaaatacatcctcaagcagtgtgcctgaaacagcaactcataattcagagactacagaatcatatagaaacggaaacagaaacgaagatgaaatggtaccttctccagattcaagaaaatgtgtgagcccaggttccaactgcaggcgaggctttgtgccgtacaagagatgtgttgctgatagtgaggcgctgctgaagtcacaggcgcctcaggaggaggcagacggagagatgacgaggctgtgcttataa

SEQ ID NO: 80 - protein, 463 aa, Oryza sativa
MARFQETKARNDQGPVADHVGHQNLMENLTDPLDSSGMDMMDEARIPKARKPYTITKQREKWTEDEHKLFLEALQLHGRAWRRIQEHIGTKTAVQIRSHAQKFFSKVIKESSGDNCNSLGAASSIQIPPPRPKRKPVHPYPRNLGSTASKNVPALKQLEKPQLQVQSLYDQDNGSPTSVLTVPQIRADTLGSESGGSPTSTIDIEERCPTPSIATAELAMELPPTNDEEVKGNGDHEEVTCDRSGVPVLRLFGKRVMVNDLHQMSAPDAGNLQTVADMEVDASAETPTSGTGKFSSHGAAEANTWNPWLTNTQQFLYYLPNGQIFSVHSALPCFTYHNEGVTCTQFSNPQVVASDQQHQHQTSEAVDYKGIQREGSWTESNTSSSSVPETATHNSETTESYRNGNRNEDEMVPSPDSRKCVSPGSNCRRGFVPYKRCVADSEALLKSQAPQEEADGEMTRLCL

SEQ ID NO: 81 - DNA, 1356 bp, Oryza sativa
atggcttccatgccgcagctggaggaaaaggattcatccgatttggcaatcaacaaaggcccgtcgctggatcttgtcaaatctcccttgatgatgaatgatgcatctgcaactgtaactgcaatgcagcccaacgaggggatggaggagttccctgtcaaggttcggaagccttacacgatcaccaagcagcgggagaagtggacggaagaagagcacgacaagttccttgaggcattgaagctgtatggtcgctcttggcgtcagatacaagagcacattggcacaaagactgctgtccaaattcggagccatgcccagaagtttttctcaaaggtggtgcgtgagcccggttccaataatgcgattgagatccctccacctaggccaaagagaaaaccacttcatccgtaccctcgaaagtgtgcgaattctggatcggacgcaaatccagcaacagcgcaattgaagcttgctcctggctcatcttcatctggctctgatcaagagaatggttctcctatatcggtgctatctgcgatgcagtcagatgcttttggatcgtcagtatccaatccatcaaccagatgtacctccccagcgtcatctgacgatggaaataacattcccacattcacgagtggggaagataataatgtgccttgtgaaccaacagtgatagatccgtcccagtcccacaaggaaatagaccaagatagaaaagacgtgaataatatgtctgaagaggattcttcagaagaagaggtgcaagaaacaagcttgaagctatttgggaggacagttgtcatcccagatccaaggaagagaagctcctcagatccgaagcatgaaagtgaggagcagatatcacagccttccaatgaagaaatgttgcaggcttcttcatcggttggggagattccagcggcatattgtgcaccaaatggttggtttatgtcatacaattctttcccattccaattcggtgaatcagcggcagatgctagaattccccctttacacgtgtggtggccttactacggttttgctcccattagccatcctagaggactaagcacagtgatgcagcagactgaaggtagtgacgagagtgacggtgtgaagagccactcatccgaatcaagttcggactccggggaaaatgtgcagatgaccgctccccagagctcgagaatagtggaatcacttggagcgatttacgtccgagactcaggttcaagttttgagctaaaaccgagcgcaaattcagcgtttgtaagagtgaagccaagcaacagcggagatgaagaggtaataaggggatttgtgccttataaaagatgcaaatttcaataa

SEQ ID NO: 82 - protein, 451 aa, Oryza sativa
MASMPQLEEKDSSDLAINKGPSLDLVKSPLMMNDASATVTAMQPNEGMEEFPVKVRKPYTITKQREKWTEEEHDKFLEALKLYGRSWRQIQEHIGTKTAVQIRSHAQKFFSKVVREPGSNNAIEIPPPRPKRKPLHPYPRKCANSGSDANPATAQLKLAPGSSSSGSDQENGSPISVLSAMQSDAFGSSVSNPSTRCTSPASSDDGNNIPTFTSGEDNNVPCEPTVIDPSQSHKEIDQDRKDVNNMSEEDSSEEEVQETSLKLFGRTVVIPDPRKRSSSDPKHESEEQISQPSNEEMLQASSSVGEIPAAYCAPNGWFMSYNSFPFQFGESAADARIPPLHVWWPYYGFAPISHPRGLSTVMQQTEGSDESDGVKSHSSESSSDSGENVQMTAPQSSRIVESLGAIYVRDSGSSFELKPSANSAFVRVKPSNSGDEEVIRGFVPYKRCKFQ

SEQ ID NO: 83 - DNA, 2338 bp, Lemna paucicostata
  misc_feature (2259)..(2259): n is a, c, g, or t
  misc_feature (2308)..(2308): n is a, c, g, or t
ctaatacgactcactatagggcaagcagtggtatcaacgcagagtacgcgggcggaaaagatcgtggctgagatttatccacttcgaagaactagagagagaaagagggagctcaagcgagcttaagtctgcggcggaggagagattcctttcttttctccgctttttccttcctcttagagctggagatctgttgccacggcttaaatctcgatccgagcggttttagccgcggaaattgcggtttgattgggcagggagatgagaaagaagagaagaagagcggagaagagatgattatcggtttttggcgccggatttagatatatgttatatcgagtacagttgtattaattcctgttaagtgatccaattaagtagaattactggattctttaatcgctatggtttcctttagtttcttggttcatcccagattatttgatgctaagccaatttgcagttattatttgaattctgtgagaaattttcacggcgaatcgaaatggagagaagatgcaggctcgaagaggattgctcgaagtgaactgctccgtcttttttgctatttgttactgcacattgcagtaatggaaacatgttcttccggagaggaattggtcataaagccaaggaaaccctacaccataaccaaacagagagagaagtggaccgaggaggaacacaacagattcctggaagccttgaagctctatggaagagcatggcagcgaatcgaagagcacattggaacaaagactgctgtgcagattagaagtcatgcacagaagttcttcactaagttagaaaaagaagccgtctccaaaggcgttcccctcggccaagtccacgacatcgacatccctcctccccgccccaagcggaaacccaacaacccttaccctcgtaagctcggtgtgggtcccacctgcccttctggctcggagagagaagataacaagacgttgactcaccttccttctctgaactccaaggggaaagccgaagattcccccgagtcgtcccacgagaaccaagctggaataaagccagataagaaaaccccggagagtccagtcattctctctctcttccacgtggcgccacctccttccaccccttcctccagcaaatccccggtgtcttccttgggtaagggaatggcagaagaaaacaaccctaaaatctgccacgttgaccgagtcaaccccaaactcccatccccgtcagcaatctcctcggtccaccaatcccatcccttctcctggccccacatcccgcccgcattctccacacatctgacgtcagccctagttcaaaaccctgcagctcatgcagctgctaacttggcagcgtcttattggttgagtgctgacgtggaagccgcctcctcagtagactccgccagctctgcgtctcccaccatggccgccgcagctgccgccaccgtggctgccgcctccgcctggtgggccacccaagggttgctccccttctgctatccttcgttcaacggctgcttcgccgctttcgcgccgccgccgactcccatcacgttgactgagtcaacgggagtcaaggttaaccctaatgtagaagaacaagaggaacagggccgttcaaaggggtcgcctttatcgtccacggactcaaaccctagcgagaagagagaagtcaacggcgagggggaggtcaaagtccaaggtcaaagcttgacccaacgagaggaaaagtcaaccctagaggggaagaatcagttggaccggtcttcctccgggtcaaacacacctggaagcgaagtggagaatgaaggtgtggagcccacagaggatgaaatgcccaaagaggaggctgttgaccctactcgccgcggagttgacccccgaaaagaagtctccaaagagggccgcctcgccttccaagcgctcttctcccgggaagttctaccgcagagcttctcccccaccgagacagaagaccaaaaggaacaaaagtcaacggaagtcaaccctcacccggaagtcaaccccgttgaccgaatccccgcagagctaagtcaacacaggctcaagcctcactgcacaggattcaagccttacaagaggtgctcggtggaggccaaacagacggagccgccgccagaagaagataaatgtagtaagagaatatgtctggagagagaggcctccatttgacttggtcaacgcttcgaccaagtctttctctctcttaccctttacctgtcaaactttggaaccncctttttttttcttctcatattctttccccaggggactgccatgattcncggtaaaaaaaaaaaaaaaaaaaaaaaaaa

SEQ ID NO: 84 - protein, 534 aa, Lemna paucicostata
METCSSGEELVIKPRKPYTITKQREKWTEEEHNRFLEALKLYGRAWQRIEEHIGTKTAVQIRSHAQKFFTKLEKEAVSKGVPLGQVHDIDIPPPRPKRKPNNPYPRKLGVGPTCPSGSEREDNKTLTHLPSLNSKGKAEDSPESSHENQAGIKPDKKTPESPVILSLFHVAPPPSTPSSSKSPVSSLGKGMAEENNPKICHVDRVNPKLPSPSAISSVHQSHPFSWPHIPPAFSTHLTSALVQNPAAHAAANLAASYWLSADVEAASSVDSASSASPTMAAAAAATVAAASAWWATQGLLPFCYPSFNGCFAAFAPPPTPITLTESTGVKVNPNVEEQEEQGRSKGSPLSSTDSNPSEKREVNGEGEVKVQGQSLTQREEKSTLEGKNQLDRSSSGSNTPGSEVENEGVEPTEDEMPKEEAVDPTRRGVDPRKEVSKEGRLAFQALFSREVLPQSFSPTETEDQKEQKSTEVNPHPEVNPVDRIPAELSQHRLKPHCTGFKPYKRCSVEAKQTEPPPEEDKCSKRICLEREASI

SEQ ID NO: 85 - DNA, 2379 bp, Lemna gibba
  misc_feature (2202)..(2202): n is a, c, g, or t
  misc_feature (2224)..(2224): n is a, c, g, or t
  misc_feature (2226)..(2226): n is a, c, g, or t
  misc_feature (2228)..(2228): n is a, c, g, or t
  misc_feature (2240)..(2240): n is a, c, g, or t
  misc_feature (2248)..(2248): n is a, c, g, or t
  misc_feature (2250)..(2250): n is a, c, g, or t
  misc_feature (2255)..(2255): n is a, c, g, or t
  misc_feature (2259)..(2259): n is a, c, g, or t
  misc_feature (2262)..(2262): n is a, c, g, or t
  misc_feature (2274)..(2274): n is a, c, g, or t
  misc_feature (2280)..(2280): n is a, c, g, or t
  misc_feature (2287)..(2288): n is a, c, g, or t
  misc_feature (2302)..(2302): n is a, c, g, or t
  misc_feature (2313)..(2313): n is a, c, g, or t
  misc_feature (2318)..(2318): n is a, c, g, or t
  misc_feature (2320)..(2320): n is a, c, g, or t
  misc_feature (2323)..(2323): n is a, c, g, or t
  misc_feature (2325)..(2325): n is a, c, g, or t
  misc_feature (2329)..(2329): n is a, c, g, or t
  misc_feature (2331)..(2331): n is a, c, g, or t
  misc_feature (2333)..(2333): n is a, c, g, or t
  misc_feature (2335)..(2335): n is a, c, g, or t
  misc_feature (2337)..(2337): n is a, c, g, or t
  misc_feature (2342)..(2343): n is a, c, g, or t
  misc_feature (2349)..(2349): n is a, c, g, or t
  misc_feature (2352)..(2352): n is a, c, g, or t
  misc_feature (2359)..(2359): n is a, c, g, or t
ctaatacgactcactatagggcaagcagtggtatcaacgcagagtacgcgggggaggaagaggaggaagcgagccttctccgagctcgatttcagcggcttccggagcctggattactctcttttcttcgctttttcctcgctctgagcactggagatcagttcaactaggtcagctctcaatctgaccagttttcccgaagaaattgggagattggggaagccaggcgatgagaaagaagaggagaagagggaattagagaagcgccttgatttttgctgtcagagttagttcaacggagttgtgaatttgattctccagttattcgtcagtccgatcgaagtcatggatagaagatgcgccctcgttggggaatatacgaattgagcctctccgtgttttttgctctttttttctgcgaattgcagttatggagacatgttcctccggagaggaattgatcgtgaagccaaggaaaccgtacacgattacgaaacagcgagagaagtggaccgaggaagaacacaacagattcctcgaagccttgaagctatacggaagagcctggcagcgaatagaagagcatattggcacaaagaccgctgtacaaataagaagtcatgcacaaaagttcttcactaagttagaaaaagaagcagtatctaaaggcgttcctctgggtcaagtccatgatattgagatccctcctccgcgccctaaacgaaaaccgaccaatccctatcctcgaaagatcggtgtgggcccctcctacccatctggaggagagagagatgataacagacaattaacgcaccttccttcttcttctttacattccaagggcaaagccgaagattttttcgtcgattcttctcccgagaagcaagcaggaatgaactcggagaaaattaccaaagaggccccagttgccctctctctcttccacgtggcgccttcttctcccaccccttcctcgagcaaatccaccgttcctttaccagatgacgaaaaaaacccaagcatcaattttgacttgaacaagaagaaccgcccttgcggagtcaacgcagaccctaatacagtcaaatttccatccccatcggccatctcctcggtccaccaatccactgctgcctttcctcatccattcagttggccccacgtcccgccggctttctccagccacctgacgtcagccctacttcagaatccggcggcgcatgcggccgccaacatggccgcgtctttctggttgactgctgacgtggagacttcttcctccgttgactccgggaatgccgccagctcgtcttcccctagtgtggcggcggcggcgattgccaccgtggcggcggcgtcagcttggtgggccacccatggactcctccctttctgctacccttcattcaacggctgcttcgccgccgttcctccgcctccgacgaccaccccgacgctgaccgaggcgacccgagtcaaagtcaaccctcgcaacggcaaagaggaagaggaaaaggatctccgtcaaggtttcgacccgggcacgtcgttgaccgcgaagggctcacctctctcgtcaacagattccaacccgagtgagaaaagagaggtcaacggcgagggggaggtcaatgtccacggtcaaccacagaaccagcagaagtccacgccggatgaggaatcttttaggagaaagggaaagaaccagttagaccgttcttcctccggatccaacactccgggcagcgaagtggacaacgatggcgcggggcccacagaggaagaaaagcccaaagacgacgacctctccgttgaccctaaccgccgaggagttgacccccgcaaggaagtctccaaagaggggcgcctcgcctttcaagcgctcttctcaagaggagtgctgccgcagagcttctcccccacagagggagaggcggagaaagatgaagtgttagcgcccgcctcggctccctcagaagtcaacgcccttcaacctccccaagtcaactccgttgaccaaacctctgtagatatcggtcaactgaggccgaagcctcactgcatagggttcaagccctacaagcgttgctcagtggaggcaaaggagaccgagcccccgccggaggacgacaaatgtagcaagagaatgtgtttggagagagaggcgtcgacttgagccggtcacgctgtctcggtctccantggttttcgacgagtcaacggngnancttggcatatcnttttcccngnggaantttngantgcctttttctncgaatntctttcnngggggaactgccgnaatccggggtnaattntnttntnggcngngncntnggaannaatttnccnttctctnccaaaaaaaaaaaaaaaaaa

SEQ ID NO: 86 - protein, 581 aa, Lemna gibba
METCSSGEELIVKPRKPYTITKQREKWTEEEHNRFLEALKLYGRAWQRIEEHIGTKTAVQIRSHAQKFFTKLEKEAVSKGVPLGQVHDIEIPPPRPKRKPTNPYPRKIGVGPSYPSGGERDDNRQLTHLPSSSLHSKGKAEDFFVDSSPEKQAGMNSEKITKEAPVALSLFHVAPSSPTPSSSKSTVPLPDDEKNPSINFDLNKKNRPCGVNADPNTVKFPSPSAISSVHQSTAAFPHPFSWPHVPPAFSSHLTSALLQNPAAHAAANMAASFWLTADVETSSSVDSGNAASSSSPSVAAAAIATVAAASAWWATHGLLPFCYPSFNGCFAAVPPPPTTTPTLTEATRVKVNPRNGKEEEEKDLRQGFDPGTSLTAKGSPLSSTDSNPSEKREVNGEGEVNVHGQPQNQQKSTPDEESFRRKGKNQLDRSSSGSNTPGSEVDNDGAGPTEEEKPKDDDLSVDPNRRGVDPRKEVSKEGRLAFQALFSRGVLPQSFSPTEGEAEKDEVLAPASAPSEVNALQPPQVNSVDQTSVDIGQLRPKPHCIGFKPYKRCSVEAKETEPPPEDDKCSKRMCLEREAST

SEQ ID NO: 87 - DNA, 2570 bp, Castanea sativa
gcgtgttttcgcatcaatttttgcgctgtagtgaggatttgaagcagccctgctggctgctccgcgtccggtaatggacacatactcctctggggaagaactggttattaaggctagaaaaccatatacaataactaagcaacgggagagatggacggaggacgagcataataggtttctagaagccttgaagctctatggacgagcatggcagcggatagaagaacatataggaacaaagactgctgtgcagatcagaagtcatgcacagaaattcttttcaaagttggagaaggaggctcttgttaaaggtgttccaataggccaagctcttgacatagatattccacctccacgccctaaaaggaaaccaagcaatccttatcctcgaaagacaagcatcggcgttcctacatcacaggtgggaacgaaggatggaaaacttttcacatcagcttcttcttcggattgcaaacaagcactggacttggagaaagaaccacttcctgagaaacctaatggagatgagaaaccagaaaatgcaaaagataatcaggatgacaattgctcagaagtctttacccttcaccaagaagttcattgttcttctgtttcttcagcaaacaggagttctgtaccgactcccgttgctctcagaaatttaaacacgttaagggagtttgtcccttcaatgaaaaggtcaataacccaagatgaaacaaatgaatcttatgtcactattgaacttaaaggaaatcagaagttggagaaagctgatgccaaacagacaattcaagatactggcacaagtaatggctcaaagttggggaatcataatgttctacatgagaagccaattcaaggtgacaagacacaggatttaaattgtgctttgccaatggatgagatgcaagccactcagaactacccaaggcatgtccctgtgcaagttgtagatggaagcttaggaacatgtactcaaactccttcctcagatatgtcattccaggactccatatttcacccaatgggagaggttcacagacaccataatccctttacaaatccagcagcatctgctaccactgaacatcaaaataatgttcccagatctgttaatcaatcatttccggctttccatcctccctttaccccaattcgccataaccaggacgactaccaatcatttctccacatgtcctccacattttcaagccttattgtctctactttgatgcaaaatcctgcagcccatgctgcagcaagttttgcagctacagtttggccctatgcaaatgtggaggcttctgcagattctcctgcaagcacgcaaggggtttttccaccgaggcaaatgggctctactccaagtatggcagctattgctgctgctactgtagctgctgcaactgcatggtgggcagcccatggactggttcccttatgtgctcctcttcctactgcttttacctgcaatcctgcatctacagctgcagttccaccaacagattctggccaagcccctgcagccaagacagagggagaagtgaatactcttcaaactcctcccttgcaacaactcgacccagaatattcagaagctgttcaagctcagcattcagactcaaaattgccaattccgtcatcatcagactctgaggagagtggaggtgcaaagctaaactctgggccaaaagctactgatcatgagaatgctgtaacagctactgagctccatgattcaaacaaaacaaaaggcagaaaacaggttgaccgttcctcatgtggttccaacacagcttctagcagtgacagggagacagatgcattagagaagcaggagatggggaaggaagagccgaaagaacctgatgcaaaccattcagctgctgatactagtaatcgtcgttgttgtagtagtagtagtagaagtttcagctacatgaatgattcctggaagtcagtctctgaagagggccggctggcctttcaagcactgttctctagagaggtactgcctcaaagtttttcacctccacatgatctgaagaacatggggaatcaaaaggacaataccacagacgataagcaaaatgcaaatgagaatgatggaaatgcatcactgttagacctcaacagtcaaaaatctgggtcttgttctgtccaacaaggaatcttaaactttgaacccaacaacaatggggaggggctgctgacaatagggcttgcatatggaaagcttaaggctcgtcgaacgggatttaagccatacaaaaggtgttcagtagaggccaaggagaatagggtggcaaatgctagtggccaaggtgaagagaagggtccaaagaggatacgcttggaaggggaggcttcaatttgagatttgatattgcattcaatcaaaggaaacctttgttgtgcatatcttattttccccgtaactatgttctaatctctttcatttcaagtccatctcacgaaacttgtcgtgcatgtgtgtgtactatattatgtctacatttgctcatatactatgttgaaccccaggcaactgcactagaagactttcc

SEQ ID NO: 88 - protein, 768 aa, Castanea sativa
MDTYSSGEELVIKARKPYTITKQRERWTEDEHNRFLEALKLYGRAWQRIEEHIGTKTAVQIRSHAQKFFSKLEKEALVKGVPIGQALDIDIPPPRPKRKPSNPYPRKTSIGVPTSQVGTKDGKLFTSASSSDCKQALDLEKEPLPEKPNGDEKPENAKDNQDDNCSEVFTLHQEVHCSSVSSANRSSVPTPVALRNLNTLREFVPSMKRSITQDETNESYVTIELKGNQKLEKADAKQTIQDTGTSNGSKLGNHNVLHEKPIQGDKTQDLNCALPMDEMQATQNYPRHVPVQVVDGSLGTCTQTPSSDMSFQDSIFHPMGEVHRHHNPFTNPAASATTEHQNNVPRSVNQSFPAFHPPFTPIRHNQDDYQSFLHMSSTFSSLIVSTLMQNPAAHAAASFAATVWPYANVEASADSPASTQGVFPPRQMGSTPSMAAIAAATVAAATAWWAAHGLVPLCAPLPTAFTCNPASTAAVPPTDSGQAPAAKTEGEVNTLQTPPLQQLDPEYSEAVQAQHSDSKLPIPSSSDSEESGGAKLNSGPKATDHENAVTATELHDSNKTKGRKQVDRSSCGSNTASSSDRETDALEKQEMGKEEPKEPDANHSAADTSNRRCCSSSSRSFSYMNDSWKSVSEEGRLAFQALFSREVLPQSFSPPHDLKNMGNQKDNTTDDKQNANENDGNASLLDLNSQKSGSCSVQQGILNFEPNNNGEGLLTIGLAYGKLKARRTGFKPYKRCSVEAKENRVANASGQGEEKGPKRIRLEGEASI

SEQ ID NO: 89 - DNA, 2172 bp, Phaseolus vulgaris
atggacgcatactcctctggagaagaagtcgttgtaaagacgagaaaaccgtatacgatcacaaagcaaagggaacgatggacagaggaggagcataataggtttctagaagctttgaaactgcacgggcgagcatggcagcgcatagaagagcatataggaacaaagactgccgtgcaaatcaggagtcacgcacagaagttctttacaaagttggagaaagaggcccttgtaaagggtgttccaattggacaagctcttgacatagatattccccctccacggcccaaaagaaaaccaagcaatccttatcctcggaagaccacgattggtaccgcaacattacatagtggagcaaaggatggaaatttggttgaatcttcacataacaaccaagcactggacttggaaaaagaaccacttccggagaaatatgatttagacgaggggctaacaacagtaaaggaaaataaggatgagaactgctcaaaagtatttaaagttatccaggaggtaccctgttcctctatatcttcagcaaacaggagttcaatatctatgtcagtgccgctgggaaattcatgcgtattaaaggagattacaagttcagtgaaagaggtaataactcgagatgaaaatactgaatcatttctgactgttgaacttggaaacaggaatttggagatcaatgatggaaaacaggctaatggcactagtaaaaactccacgttggagaattctgatgctttacaaacgaaattggttcaaaatgagaaaacagatggtctcgatagtgcattaacaatagatgggatgcaaggcaatcagaattaccctagacatgtaactgtgcacgttgttgacgggaaacttggaacaagtactcaaaatccatcacaagatatgctgtttcgagactctatgtttcagccaataggaggggataatgggcaaccaaatcttttcaccaattcagctccaacgaacacaagtgaaagtcaaaataatacagcacgatcttctgttcatcaatcatttcttccgtatcctcccttcacacagcacaatcaggacgattaccaatcatttcttcacatgtcttccacgttttctaatcttgttgtctctaccttgctgcaaaacccagcagcccatgttgcagcaagtttcgcagctacattttggccttatgcaaatccagaaacttcagcagattctcctaggtgctcccaaggaggtttcacatctagacaaatcggttcccctccaagcgttgcagctattgcagcagctactgtagctgctgcaactgcgtggtgggcagctcatggattgcttcctttgtgtcttcctcttcatgctgcttttgcctgtcctcctgcatcagtgactgcagtcccatcaatgaatcctcctgtgcaagatcagaagcatccagaatactcggaagcaccgcaagctcaacattcagattcaaagtcactagctgtcatttcatcagattctgagactggaaatgccaagttaaatacttcaccaaaggctactgatcatgtgacgaacgaaacaatttctgagcaccttgattccgacaaaacaaagggcagaaaacaggttgaccgttcctcgtgtggttccaacacagcctcaagcagcgatgtggaaactgatgcactagggaaggatgagaaagggaaggaagagcctgaaacacccgacgctaacaatttagccattgagtttagtaatcgtcgtagaagcatttacaaccttactgattcttggaaagaggtctcttcagaggggagactagcatttcaggctctattctccagagaggtgttgcctcaaagcttttcacctcctcatgctctaaagaataaggaccaaatggacatcaccaatgattacaagcaaaacatagccgacagaaatgaagaccttgacagcaagaaatgcagttctaatgcactgcataaaattccgtcgtttgtagaaaataacgtgggactgttaaccattgggcttggacaaggaaagcttaagactcgtcgaacaggctttaaaccctacaaaagatgttccgtggaggccagggaaaatagggttggagcgaactgtgaagagaaaggttgtaagagaatacgtttggaaggggatacttcgacttga

SEQ ID NO: 90 - protein, 723 aa, Phaseolus vulgaris
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPSNPYPRKTTIGTATLHSGAKDGNLVESSHNNQALDLEKEPLPEKYDLDEGLTTVKENKDENCSKVFKVIQEVPCSSISSANRSSISMSVPLGNSCVLKEITSSVKEVITRDENTESFLTVELGNRNLEINDGKQANGTSKNSTLENSDALQTKLVQNEKTDGLDSALTIDGMQGNQNYPRHVTVHVVDGKLGTSTQNPSQDMLFRDSMFQPIGGDNGQPNLFTNSAPTNTSESQNNTARSSVHQSFLPYPPFTQHNQDDYQSFLHMSSTFSNLVVSTLLQNPAAHVAASFAATFWPYANPETSADSPRCSQGGFTSRQIGSPPSVAAIAAATVAAATAWWAAHGLLPLCLPLHAAFACPPASVTAVPSMNPPVQDQKHPEYSEAPQAQHSDSKSLAVISSDSETGNAKLNTSPKATDHVTNETISEHLDSDKTKGRKQVDRSSCGSNTASSSDVETDALGKDEKGKEEPETPDANNLAIEFSNRRRSIYNLTDSWKEVSSEGRLAFQALFSREVLPQSFSPPHALKNKDQMDITNDYKQNIADRNEDLDSKKCSSNALHKIPSFVENNVGLLTIGLGQGKLKTRRTGFKPYKRCSVEARENRVGANCEEKGCKRIRLEGDTST

SEQ ID NO: 91 - DNA, 1036 bp, Glycine max
gtttcttcctccgatccctcattgccgcaaatgactcctcctgctagtgttaggtgaattccctcgcttcacatgcatgatcgcaccttcaactctcttcttcttcttcttctccatggctttttttcaaggttttggcgccgtggagttcgttttggtgaggattctgattaaagagttttcttttattctttcggagaagcgtctctgtctctctgttgcggtggattcttaaaatttgctaaatctttttttttctttttctaatctctattagtatcatcctgcgtgtggcttgtgattggaatgcttagatttatattttttgttaccaaacagagacggatctctacctttctatttcttttgcagtagcatcaccgtatcatcagcttcagcttgctttcaccaaaacggctttactatttggtgtgttccatgtcacaaaaaacgaaaggagatattccttttacccactcctcgtcagggaagatctgaagcagcgctagcagcacacgtcctctaatggacgccgactcctctggagaagaagtggttattaaaacaagaaaaccatatactatcacaaagcaaagagaacgatggacagaggaggaacataacagatttctagaagccttgaagctatacgggcgagcatggcagcgcatagaagagcatataggaacaaagactgctgtacaaatcaggagtcatgctcagaaattctttacaaagttggagaaagaggcctttgtaaagggtgttccaataggacaagctcttgatatagacatcccccctccacggccaaaaagaaaaccaaacaatccttatccccggaagaccaatgttggtggtgccccaacattacatagcggagcaaggcatggaaagcctctcatttcaattgtatcttcacttggtaaacaagcattgggcttggagaaagaaccccttccagagaagcatgatgtcgacctaaggccatcaaccgtaaaagaaaataaggaccaaagctgctcaaaagtattta

SEQ ID NO: 92 - protein, 170 aa, Glycine max
MDADSSGEEVVIKTRKPYTITKQRERWTEEEHNRFLEALKLYGRAWQRIEEHIGTKTAVQIRSHAQKFFTKLEKEAFVKGVPIGQALDIDIPPPRPKRKPNNPYPRKTNVGGAPTLHSGARHGKPLISIVSSLGKQALGLEKEPLPEKHDVDLRPSTVKENKDQSCSKVF

SEQ ID NO: 93 - DNA, 3051 bp, Mesembryanthemum crystallinum
gggggtgtggcgcattttctctctcctcgcgctcgagttcaaacactcctgttcttcttcaattcctttttagtgttttttttgagaggtttaatcaatatactagaaattcggcaatcaaatggggtgagtttattctgtcaatcatttgtatgatcatttagtggattgagcgttcgattgattgtttctcgtcttctcgatctgctatggcatcttcagaaggtgtgagcacgttctcgactgtttcggtgaggattctgaacaaggaaatttttaccgctttctagagctggatggattgtcaatttgatttgggaaacatgggggaagaaagggagtcttttcatttttatgacgattagttaggtttcagtatatgaaaattttattatttttgttttggaaatggttgtttaaattgatagtattatttgggcgacaaaaaagacaggatctctatcgattttagttttcttggtttgctacttgtttgtatttctgcagtagtgattttactcaccagatttcaacgagtgtatgttcagtactactctctgatgtgtggagggataagaggccgcttttgtataccttgcttgttggagagcagctgaaagcagtggtagcggtagctccggctaccgctatggaggcttattcttccggagaagagctagttattaagacaagaaaaccttatacgatcaccaagcaacgagagcgatggacagaagaggagcataataggtttttagaggccttgaaactctatggacgagcttggcagcggatagaagagcatattggaacaaagaccgctgtccagatccgaagtcatgcacagaagttcttttcaaagttggaaaaggaggctcttgttaaaggtgttccaatacagcaagcaatcgacatagaaattcctcctccacgacctaagaggaaaccgagcaatccttatcctcgcaagactggagctgcaggttctccaagtacacagatcaaagttaaggatgggaacaaagtaccaccaggttcttcacatactgcaaaccagttactagacttggaaaaagaacctccaccagagaacactactggtgatgatgggaagcaaaatgctaaagaaacctgtggtgcttacaaatgctcagaaacctttactctgttccaagaagcaccatccaccttgacagcatccggtaatgaaaactctgccataacaacgggtgcaacgagaaagtcatgcaaggttgatgaccctgtgccaaagaaactgttggtcgatattgacggaagtgattgtcctgctgctgatggacgacagagaaatcaaaaactagataaaactgatactgtggagactgctcagaatgacacagaaaacgaaatgcatgctgttaagaactttcctagacatactcctgttcatattcttgatggaagcctaggagcatgcagtcaagctctttcctcagacgtatcatatcaagaatctgcatttcatcggatgggaatcccaggctatcctgcaatttttagcaatcctgcagtatcagctgctgtggaaagtcaaaatagcacatcaagaaccactaatcaacaaatgtttacaagcttccatcctccatttactccattccctaacaccccagaagactattcatcatttgtgcagatgtctgctaccttttcaagtctgattgtgtctgctcttcttcaaaacccagctgcacatgctgcagcaagttttgctgcttccttttggccttgctctaatatggaaaattcagccaattgtcctgctggtctaagtggcggattcccaccacggccaatgaatacggctccaagcatggcagcaattgctggagccacagtagcagctgctactgcttggtgggcagcacatggtctcttgcccttatgtgctcctgtacattctggcttcaattgtcctcctgcctctgctaatgccccattaactaatgttgcccaaagtcaagccactaataaggaaagagaggagaacaatttccaaaatcctggttcacaagttcagcaacctgatcaggaactctctgaagctttgcagccacagcattcagcatccaaaccttcagcaacatcgtcatctgattctggtgacagtgcaggtgcaaagatggaaattgaaataccaaccaatgataatgagataaaggtccctgcaatgactgagcaaaaggactcaagcaagggcaagagcaagaaactggtggaccgctcttcttgtggttccaacacaccctcaggtagtgatgttgagactgatgctttgcagaagaatgataaaggcaaggaagaacccctagaacctgatattagtcaaattgctggtgaacttaataatcgtcgcaatcgaattgcaagcaacaacttaaatgacagctggaaggaggtttccgaggggggacgccttgcgtttcaagcacttttctctagagagagattgccccagagcttttcacccccacaagacgtaagtattatggaccaggtaatgaataatggtgttgagagaaatgggcaaaatgcaacagaaaccaatgaagatgcatcacagttagatctcaacagcaatacatgggaatcttgttcaggtgatcaagggcacctagagaacactggattaagagagaaggaaaatggaaaagatcacttcctgtcaattggtcttgctcaagggaagccaagggaccgtagaacaggttttaagccgtacaaaaggtgctctgttgaagccagggagagtaggttgaactcaaacagtcaagaccaagaaaaatgtcccaagagaatacgcttggaaggggaggcttcaacgtgatatcagattatgcttgcgttttgtgctagggaaaccttggccacagcaagtataccccatttatttttagtttctttatttcacttagctttatttaagttcttaaaagctcacgagacttttcgtgttgtgtgtactataactgactaaattggtctttcatttttcatccttcgtgttat

SEQ ID NO: 94 - protein, 739 aa, Mesembryanthemum crystallinum
MEAYSSGEELVIKTRKPYTITKQRERWTEEEHNRFLEALKLYGRAWQRIEEHIGTKTAVQIRSHAQKFFSKLEKEALVKGVPIQQAIDIEIPPPRPKRKPSNPYPRKTGAAGSPSTQIKVKDGNKVPPGSSHTANQLLDLEKEPPPENTTGDDGKQNAKETCGAYKCSETFTLFQEAPSTLTASGNENSAITTGATRKSCKVDDPVPKKLLVDIDGSDCPAADGRQRNQKLDKTDTVETAQNDTENEMHAVKNFPRHTPVHILDGSLGACSQALSSDVSYQESAFHRMGIPGYPAIFSNPAVSAAVESQNSTSRTTNQQMFTSFHPPFTPFPNTPEDYSSFVQMSATFSSLIVSALLQNPAAHAAASFAASFWPCSNMENSANCPAGLSGGFPPRPMNTAPSMAAIAGATVAAATAWWAAHGLLPLCAPVHSGFNCPPASANAPLTNVAQSQATNKEREENNFQNPGSQVQQPDQELSEALQPQHSASKPSATSSSDSGDSAGAKMEIEIPTNDNEIKVPAMTEQKDSSKGKSKKLVDRSSCGSNTPSGSDVETDALQKNDKGKEEPLEPDISQIAGELNNRRNRIASNNLNDSWKEVSEGGRLAFQALFSRERLPQSFSPPQDVSIMDQVMNNGVERNGQNATETNEDASQLDLNSNTWESCSGDQGHLENTGLREKENGKDHFLSIGLAQGKPRDRRTGFKPYKRCSVEARESRLNSNSQDQEKCPKRIRLEGEAST

SEQ ID NO: 95 - DNA, 2735 bp, Lycopersicon esculentum
aacatggctttcttcgaaggtttaggcatcatgcggttcgttttgtagtgttacattatcaggttcttttgtacaacaccacggatagactatatttgatagtaactgatgttgtggggagaatcggaagaagatttgttctgtatcccctgtttgtccctgaggatttgaagcagagatagctagctttggttcctttattttgatggacccttattcctcaggggaggaacttgttgttaagacaaggaaaccttatacaatcactaagcaacgagagcgatggacggaggaggagcacaataggttcctagaagctttgaaactttatgggcgtgcttggcagcgcatagaagaacacataggaactaaaactgctgtgcagatcagaagtcatgcgcaaaagttttttacaaagttagaaaaggaggctcttacaaagggggtcccaacaagtcaagcacttgacattgaaattcctcctccacgacctaaaaggaaaccaagtaatccttatcctcgtaagacaagcgcagcaggtcactcatcacaggtgggagcaaaagatgggaaatattcgacaactttttcttccatctgtgaggaaaggaacttatttgacctggagaaagaaccgattactgagaaacctggcggaaacgagaagctgggcaatgtaaaagaaacccagaacaagaaaaactgctcccaagggttaactaaggaaggtgcttctgcagcctctatgtcttcaggaaagtccttgcaagcacatgtggcacctacagatgtgtgtgcctttagtgagtctgtgtctgtcaccaaaggagtggttaacaatgataacgcaaataaatcttttctcattgttgaatccaaagaacatcaacagtcagaaatactcgatatcagacagtcctttcaaggtaacagctcctgtaacacctttgacggggggaaatcttgccagtcgagtgaaaagttggcacaaggtgagaaaaaacatccatcgtttcagccaaaccatttgggggaattctcaagaaatgatatgcaagtgctacacaactatccaagacatgtgccagtgcatattcttgatggaacaaatggttctcaaatagccccagatatgtttaatcatgaatctacgagtcagcagataaatggggtcccggggctcccaaatttgtattctaaccctgcttcatccaccacatctgagcaccacagtaacgctccacagtcatccattcatcagtcattttcttgtttccaccccattttcacccctattcgtgatccagatgattaccgatcgttttttcaattatcctccaccttctccagccttattgtttctgctttattgcaaaacccagcagcacatgtcgcagcaagttttgccgctagcttttggccttatgcaaatatggaacgtccaacggattctccaactgataacaccgctagccagattaactcagctcctagtatggcagcaattgctgctgccacagtagcagctgcaactgcatggtgggcagcccatgggctcttaccattgtgctctcaatttcaaagcagttttacctgtgttcctacatcagcaacatcaatgcaagtggatgcctgtcaacctagagtagacaagaacgaaggaagagagggaactcatgattctccccatgttcaggaacctgtcccagaatgctctgaagctttgcaagaacaacaatcaggttctaagttgccaccttctctatcatcagaatcggaggagagtgaaggtaggaagctaaaaactgggttaacggccactgatactgagcaaggagctgcagttactaaaattaatgagccaaacgcagaaaagggcgggaagcaggtagatcgctcttcctgtggatccaacacaccttcaagtagtgaaattgagacagatgctttggagaaggatgagaaaggtaaagaagagccccaagaatctaatattaaccttctagctggagaggctgcgaatcggcgttatagaaatttcatcagtccaaccgaatcttggaaagaagtctccgaagagggacggatagctttccaggctcttttcaccagagaagtgttgcctcaaagtttttctccttcacttgatctgaaaaataagggaaagatcattcttgaaaagttgaagcaaaagccagacgagaaagttcaatgtggaccgcagttagatcttaatgatatggcatccaatatctgttccagtcaccaaacaatggaagacaatgtgttattaattggcaacaaagaagatgtagaaacatgcctaccaatgatagaacttggacaagtaaggttgaaagctcgccgtactggatttaagccttacaagaggtgctcattggaggcaaatgatagcagggtgacaagttctaactgtcaggatgaagaaaaaagctcgaaaagacttcggttggaaggagaagcttctacttagtgttgtatcaatgtgcaattctacgagggaacctgtgttgttgcacggagagctctattctatcctgttattatcttttcccagttacgttgtctagttctaatgtacacgaaacttgtcgtgtaggtgtgtaccatattatttttatgttctcttttaattggacttgtatgcaagggactttgaagtatgaacctaaatgtggatgtcttcaacaatcatagcaaaaaaaaaaaaaaaa

SEQ ID NO: 96 - protein, 762 aa, Lycopersicon esculentum
MDPYSSGEELVVKTRKPYTITKQRERWTEEEHNRFLEALKLYGRAWQRIEEHIGTKTAVQIRSHAQKFFTKLEKEALTKGVPTSQALDIEIPPPRPKRKPSNPYPRKTSAAGHSSQVGAKDGKYSTTFSSICEERNLFDLEKEPITEKPGGNEKLGNVKETQNKKNCSQGLTKEGASAASMSSGKSLQAHVAPTDVCAFSESVSVTKGVVNNDNANKSFLIVESKEHQQSEILDIRQSFQGNSSCNTFDGGKSCQSSEKLAQGEKKHPSFQPNHLGEFSRNDMQVLHNYPRHVPVHILDGTNGSQIAPDMFNHESTSQQINGVPGLPNLYSNPASSTTSEHHSNAPQSSIHQSFSCFHPIFTPIRDPDDYRSFFQLSSTFSSLIVSALLQNPAAHVAASFAASFWPYANMERPTDSPTDNTASQINSAPSMAAIAAATVAAATAWWAAHGLLPLCSQFQSSFTCVPTSATSMQVDACQPRVDKNEGREGTHDSPHVQEPVPECSEALQEQQSGSKLPPSLSSESEESEGRKLKTGLTATDTEQGAAVTKINEPNAEKGGKQVDRSSCGSNTPSSSEIETDALEKDEKGKEEPQESNINLLAGEAANRRYRNFISPTESWKEVSEEGRIAFQALFTREVLPQSFSPSLDLKNKGKIILEKLKQKPDEKVQCGPQLDLNDMASNICSSHQTMEDNVLLIGNKEDVETCLPMIELGQVRLKARRTGFKPYKRCSLEANDSRVTSSNCQDEEKSSKRLRLEGEAST

SEQ ID NO: 97 - DNA, 516 bp, Glycine max
  misc_feature (340)..(340): n is a, c, g, or t
acgagcagagacggatctcttcctattgttctcgctttgtttcttttgcagtagcatcatcatcatcaccataccttgttcagattctgctcactttcaccacaacggctttactatttaccgcgtttagttttcgtgtcaccgcaaataatgaaaggaggtgttccctgtatccactcctcgtcagggaagatctgaagcagtgctagctgctcacgtcctgtaatggacgcatactcctccggcgaagaagtggttgctaagactagaaaaccatatacaatcactaagcaaagggaacgatggacagaggaggagcataataggtttctagaagctntgaaactacacgggcgaccatggcagcgcatagaagagcatataggaacaaagactgccgtgcaaataaggagtcatgcacagaagttctttacaaagctggagaaagaggcccttgtaaagggtgttccaattggacatgctcttgatatagacatatcccctccacggcccaaa

SEQ ID NO: 98 - protein, 97 aa, Glycine max
  UNSURE (39)..(39): Xaa can be any naturally occurring amino acid
MDAYSSGEEVVAKTRKPYTITKQRERWTEEEHNRFLEAXKLHGRPWQRIEEHIGTKTAVQIRSHAQKFFTKLEKEALVKGVPIGHALDIDISPPRPK

SEQ ID NO: 99 - DNA, 2290 bp, Lemna gibba
  misc_feature (2200)..(2200): n is a, c, g, or t
  misc_feature (2217)..(2217): n is a, c, g, or t
  misc_feature (2237)..(2237): n is a, c, g, or t
  misc_feature (2266)..(2269): n is a, c, g, or t
  misc_feature (2271)..(2271): n is a, c, g, or t
  misc_feature (2283)..(2287): n is a, c, g, or t
ctaatacgactcactatagggcaagcagtggtatcaacgcagagtacgcgggggttcgtccaggtgcacttcaaaaaaacttccttccttctccattcgaccattgaggtctcgccacgtggatccgattcgcctttcgaaagattttccaggccgagaaatctcctcgcggatggagtggcggagagctctccagaaggtgacttctggctggatttagctggtaatcaaccactacagtaagttccttctctgctccctccgccggcggatcaccggattccgtctattaggtgaaagccgtccggatccgtggaggagaagcggccatgaggaagaagaagcggagggatccggagagctttttccgtttttaagttcttgattgaaggttgcgccaaggtctgtgccttttattttcctaaattgttttccctccgaggttctgcaggatgatccggccgcggtatccaaggcgcgaggttgaaatgaatctctacgtttcgaattgatttatcgatggtgtttggaaacgagttcttcaggtcgaacgtctgatcgaagacctcgtggttgaagatctgcggtagagagaattcccgatcctctcggctctgcgaaatggatgcaatctcctccggagaggatttcattttaaagacaaggaaaccgtatacgataacgaagcagcgggaaaagtggactgaagaggagcacagaaaattcctggaggctttgaaactctatggccgatcttggcagcgcattgaagaacatatcggcactaagacagctgttcaaataaggagtcacgctcagaaatttttctctaagcttgaaaaggaagcggtaatcaaaggcgttcccttaggacaagctcatggcatcgagatccctccaccccgccccaagcgcaagcctaacatcccctaccctcgaaaaatctcctccgacattgatgggtctcaccagaaggtggcatccgacgaggacaagtgcttcatgggccttgcgctctttcaagactcgccttgcacgacaaagcccagttcggatgttgaccttggtagattcgagggcctcagcattgattcttgtgttaggaaaggagacgcaaagtcaacttcccacggcggctccatgtcaggggtcacgagagatcaacacaaggcgaagtctatgccattcgccgcctccgacttctccgcattcttcaacctgtccgcacagttttcaaaccttgtcatctcaaccctgttgcagaatccagccgcccacgcggctgccacgctggcagcttcattctggcctgctgctggcatgaagacttccacgggtaccacgccagacaatcagacaaatccaaccccaagcatggaggcaatcgtagccgccacggtggcggccgcatcagcatggtgggccgcccatggattattacccctttgtcctctggcagggttattcccgggtatctctgcattctctccgggcccgaaagtggaagaggcggcaaacccaagatcaaagtcaatgccttcgtcatccgactccgacgagctgaacccaacaaagcaggtgagttgtagtaaaccagatgaatctggaagagagaagaagaaggcggaccgatcctcttgtggctccaacacaccttccagcagcgatgtggagacggacgttgtattggaccttgaaaaggaggaccttcatctgggcctggcctactcggcttcctggaaagaagtctctcaccagggtcgtgaggcgtttcaagcactgttcaatcgagaggtgctgccgcagagcttctcgccccccaaggaagaggaaggccgggccaagccgcggcgaaccgggttcaagccctacaagaggtgctccgcgaccccgacccacgcttccggcgaaaacgacaggaagagaatacgcctccagaacgagccctcactctgaaatctttcattagtggaatttctcgactacatttatttatccttatgttttctagaaagagaactcgccgagcagcggtgaagatgggattctatgcaggcgatgtaccaaagtattctctgctggtcggcgtatgagagagaaaatggaggactcaagggcagagatggaccttctcttacaaggaatgagaagagaatgacagcattagaatattccactatagcactatccaagtttcccnagaattcatccacctgnaaataattaattaaaataantattatcaccattttttttatttcgtaannnnanaataagcgctgnnnnnagg

SEQ ID NO: 100 - protein, 444 aa, Lemna gibba
MDAISSGEDFILKTRKPYTITKQREKWTEEEHRKFLEALKLYGRSWQRIEEHIGTKTAVQIRSHAQKFFSKLEKEAVIKGVPLGQAHGIEIPPPRPKRKPNIPYPRKISSDIDGSHQKVASDEDKCFMGLALFQDSPCTTKPSSDVDLGRFEGLSIDSCVRKGDAKSTSHGGSMSGVTRDQHKAKSMPFAASDFSAFFNLSAQFSNLVISTLLQNPAAHAAATLAASFWPAAGMKTSTGTTPDNQTNPTPSMEAIVAATVAAASAWWAAHGLLPLCPLAGLFPGISAFSPGPKVEEAANPRSKSMPSSSDSDELNPTKQVSCSKPDESGREKKKADRSSCGSNTPSSSDVETDVVLDLEKEDLHLGLAYSASWKEVSHQGREAFQALFNREVLPQSFSPPKEEEGRAKPRRTGFKPYKRCSATPTHASGENDRKRIRLQNEPSL

SEQ ID NO: 101 - DNA, 1466 bp, Zea mays
  misc_feature (1392)..(1392): n is a, c, g, or t
  misc_feature (1406)..(1406): n is a, c, g, or t
  misc_feature (1418)..(1418): n is a, c, g, or t
  misc_feature (1425)..(1425): n is a, c, g, or t
  misc_feature (1444)..(1444): n is a, c, g, or t
ccacgcgtccgctgcctgctcacttccgttccgtagtccagctagatccccgggcaaccgatccaccgagaagcttgtggttgtggcggcggcggagagggaagcggggagcgggaggtcggaggcctccgtgcgtcggaggtggacgagggagcgaggcggcgccagaccgaggttgcgtcgggctcgatttctactgggctgctgtctgctgagtttacggaagtgtttggccctagaagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggaggtgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacggggacagctagcgttccagtgactgtacctgaanggactccatcctgntcaaacaagtgntccagtngggatccatgggagcatgnacccatggatccatcccatggt

SEQ ID NO: 102 - protein, 280 aa, Zea mays
MEVNSSGEETVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGDS

SEQ ID NO: 103 - DNA, 1787 bp, Lemna paucicostata
  misc_feature (1757)..(1758): n is a, c, g, or t
  misc_feature (1769)..(1769): n is a, c, g, or t
  misc_feature (1772)..(1772): n is a, c, g, or t
  misc_feature (1778)..(1778): n is a, c, g, or t
ctaatacgactcactatagggcaagcagtggtatcaacgcagagtacgcggaagcagtggtatcaacccagagtacgcgggaaatcttcgcaagaatctagtggcggagagcgccggcgaaattctggctggtatttagctggtcgtcgagctccggtgccattctttttcgcccccattggccgcggcttcagaatcggggagaaaggcgccgcggatccgtggaggcagtcatgagaaagaggaagaggaggaatttgggatgattaatccgtgctagtattcccgatcgtctgatctctgcattatggatgtgaactcctcgggagaggacttcgtcttgaaggcgaggaaaccgtacacgattacgaagcagcgggaaaagtggactgaagaggagcacaacaagttcttacaggctttgaagctctacggccgatcttggcagcgaattgaagaacacatcggctctaagactgctgtccaaattgggagccacgcacaaaaattcttctcaaagcttgaaaaggaagccctcatcaaaggtgttcccttggggcaaggccaaggcatcgagatccctcctccccgtccgaagcgcaagcctaacaacccataccctctcaaaacctccatctctaatggcattggcgggctccaccagaagaaagcttcttcagatgaggacttattgggactttcactcttccatgatccatcctgcaaaacaaagcccagcccggatgttgaacttggcagatttgagggtctcagaatcgacacgagtctgaagaaaggtgattcaaagccaaaatccatcagcggcaccacgtcgggaacaacaacagaccagaatgctgaaaagtcaatgcaattgaccgcttctgccttccctccattcttcaacatgtcagcggagttttccagcttagtagtctcaaccttgctgcagaacccagctgcctatgccactgcaatgctggcagcttccttctggccacctgctgacgtagacacttcttcggatcccggatcagacggacggataaaccccactccaagtattgcagccattgctgctgccacagtggccgccgcgtctgcatggtgggctatgcatggattattaccattttgcccccctgcaggattatttcctggcgtcttccccttggctccgagcctgacagtggaagaagctggtcaaaggtcaaagtcaattccctcgtcttctgaatccgacgagcggaatccagcaaatgaaacgaatcgcgagccggacgaacccagaggagagaagaagaaggcggaccggtcctcttgtggctccaacacgccctccagcagcgatatggagaccaatgctgtattggaccttgaaaaggaggaccttcatcttggcccggcccactctccctcctggaaggaagtctcccaccagggccgtaaggcgttccaagcgctgttctccagagaggtgctgccgcagagcttctcgcccccgaaggaagaggaaggccggtctaaaccgcggcgaaccgggttcaaaccttacaagagatcctctgcatccccggttcatgcttccagtgaaaacgacgtaaagagattacgcctacaaaatgagtccttcccctgaacttgcttattattgctttcttgaaaaagaactccttgagcctaacagagtaacgtgtataaaagtagtctctgctttgtttacttatgaaaggataatgaagaatttaacggaatannaaaaaaaaaanaanaaaaanaaaaaaaaa

SEQ ID NO: 104 - protein, 443 aa, Lemna paucicostata
MDVNSSGEDFVLKARKPYTITKQREKWTEEEHNKFLQALKLYGRSWQRIEEHIGSKTAVQIGSHAQKFFSKLEKEALIKGVPLGQGQGIEIPPPRPKRKPNNPYPLKTSISNGIGGLHQKKASSDEDLLGLSLFHDPSCKTKPSPDVELGRFEGLRIDTSLKKGDSKPKSISGTTSGTTTDQNAEKSMQLTASAFPPFFNMSAEFSSLVVSTLLQNPAAYATAMLAASFWPPADVDTSSDPGSDGRINPTPSIAAIAAATVAAASAWWAMHGLLPFCPPAGLFPGVFPLAPSLTVEEAGQRSKSIPSSSESDERNPANETNREPDEPRGEKKKADRSSCGSNTPSSSDMETNAVLDLEKEDLHLGPAHSPSWKEVSHQGRKAFQALFSREVLPQSFSPPKEEEGRSKPRRTGFKPYKRSSASPVHASSENDVKRLRLQNESFP

SEQ ID NO: 105 - DNA, 1439 bp, Glycine max
cgcggatccgccaaccacagaggagaagatattcaccacatggcgatacaaggccaaaatgcatttactagatcacagggtggtcttccaattggagatgaaatatctttcaattctggtgtgcattctgttgcagatattccactacatgatcagttatcttgtggaaatgactatgccttgaaggttaggaaaccatatactatcacaaagcagagagagaggtggacagatgaagaacataagaagttccttgaagccttaaagctatatggcagggcctggcgacggattgaagaacatgttggcacaaagactgctgttcagattcgaagtcatgctcagaagtttttttctaagattcttcgagagtctagtgggaacagtacaaccttggaggagtcaattgaaattccacctccgcgaccaaaacggaagccaattcatccttaccctcgtaagctagttgagtttccaaagacaggaatttccaactcagaacacccactgaggtctaattctctgaagtcatcagattttggtcaagaaaacaattctcccaagtcagttttatctacagttgtttcagaaactgttggttcctccgattcagatacatctagtcgatgtttgtcaccagcctcatccattagtggtgtccccacaaacagatttccacttgctgagcccaaaacatcatttaaggaagaagggtctgcaccaagttcagctcatgatgagcaacctcctgtgaaactggagtttcttcacaaagaaagtgtttctaccagagatgatgcaacagaagaatcatctggtcgtactctcaaactttttgggaccactctactggtaacagacacatgcaaaccttcttccccaacaacggagccgtgcaaaccaacacctgcggctgcaatgtatcttatgcaacttcagaatggatgttcagatgttacagaaggtcatgcttctattgttccttggtggactcttccccacaatactccatttatgccactgcacaaggagccaaaagggaagcatctatattctaatcttggagagtttgaacataaagaagttcaaaaggaaggatcatggactggttcaaacactagttcaattgatgatggagataacactgaaaaatcaggtgatcaagccaaaagtcatgtacatggttttagcaaaagtgaaactttaactatatctgagctaagggtgaggcctaaaacatgtggaaaagggtttgtaccatataaaaggtgcatggcagagagggaaaaccagtgctcatcagtatattatgaggaaagggaagagcaacgtattaagctttccttatagtaccctcttattggcttttcttcaaagcagtttcccttttacaggtataatgtacctgtttctgttgctggatgaccttgggtaccccg

SEQ ID NO: 106 - protein, 436 aa, Glycine max
MAIQGQNAFTRSQGGLPIGDEISFNSGVHSVADIPLHDQLSCGNDYALKVRKPYTITKQRERWTDEEHKKFLEALKLYGRAWRRIEEHVGTKTAVQIRSHAQKFFSKILRESSGNSTTLEESIEIPPPRPKRKPIHPYPRKLVEFPKTGISNSEHPLRSNSLKSSDFGQENNSPKSVLSTVVSETVGSSDSDTSSRCLSPASSISGVPTNRFPLAEPKTSFKEEGSAPSSAHDEQPPVKLEFLHKESVSTRDDATEESSGRTLKLFGTTLLVTDTCKPSSPTTEPCKPTPAAAMYLMQLQNGCSDVTEGHASIVPWWTLPHNTPFMPLHKEPKGKHLYSNLGEFEHKEVQKEGSWTGSNTSSIDDGDNTEKSGDQAKSHVHGFSKSETLTISELRVRPKTCGKGFVPYKRCMAERENQCSSVYYEEREEQRIKLSL

SEQ ID NO: 107 - DNA, 1999 bp, Triticum aestivum
ctcgtgccgaattcggcacgagctcgtgccgcgcctcttcgcctctcttctcttctcctgcctgcccctccctcctcgcgctccatcgacaacgagcacctcgtcttgttcttggtcttggcttttggtgtggcgacgttgggtagtgtgattatcttgttctcgctggcaggagatggcctgtacgcaggagaacgccatggcaaccgacgaaagcacggcggatcatcgcgggagtcgtccgagttcccacgacatggatttatcaggggatgaccacgtgccaaaggcacgcaagccgtacaccatcacgaagcagcgggagaagtggaccgaggaagagcacaagcgcttcctggaggccctgcagctgcacggccgcgcctggcgccgcatacaagagcacataggcaccaagacggcagtgcaaatccggagccacgcgcagaagttcttctctaaggtcaccagagagtcgtccgggagctgcagcggctcgggcgccgcggccgcgacggcgacggcggcgatccagatccccccgccgcggcccaagaggaaaccgacgcacccgtacccgcgcaaagcggacgacggcgcggcggccggcggtaagcacgccccggggctcacgcatctggagaggcctcccgtgcggatgggcgagcaggaggaagggtcgccgacgtcggtgctgaccgcgtcgcgggtcgaggcctccggtggccgcttctcctacaactccagcggcagcaggtcgccggttccgtcggccgccggctccctctacggctcgtcggtggacagaggggacggctgcctctcgcctaatacgactaaggcttcagagttcactgcaaatggtgatgtcaaagaggggtcatgtacaggatcagcgacatcagtccttaagctattcggcaagaaagtcgtggtgaatgattcattccagaagccgaataccagcaccggcaacccgcagaatggtggcgacgtcggaactgaagcttcagacgatacaaccacacaaggaagcagaaacctaccttctggcggtgccacagaaggaagctcatggaatccatggccgagcagcatgcagcagtttgtgtattttgttcctcaaccggatggtttcgccacacaatctgcggtgccatggtttggcaccctgcctggtgcaatgttctaccagcaagccatggctccaaatcagcaccagcgccatcgctcagagaccgcagaccacaagttcatgcagagggaaggatcctggacaggatcaaacactggccctggatcagctgcgcataattcagatgctgccgactcccgagggagaggaaacagcagtgagagcgacaaaacgcctgtgccgcggttaacaaagtgcgagagctctgtttcggtcagtctgcaaagaggtttcatgccatacaagagatgcgcggccgagagcgaatcgctgcggtcggaggcgcccagagaggagaccgacggtgagttgacgaggctgtgcttgtgacagccgaagattcgacacgctcttcacagtttagatgtttgctagttttgctctagactcttgagctggtggtgtgatctgcagtgggaagaagcgaccactcatcctgctggttttgcctgtcggtatgtcgcacttctccgaagcagctcgaagccgcattagattgagcatttctggttcttgctcgtgaatatatatagttggaatatgtagtatccatgtttttgttctctacagagtgtctctgcagtttttaccccaaatcgggaggctcagagttcagtgttgttgcctgtatcaacctgggcctgagagagggttgtcgtagtcttaactgcatgttgtaagctaggcaggcttgtatcactctgtagtctgcattctgtaaaacatatgataggcagaagacgaacaaaaacgtcgaatgctctgtatatctaaagtataacataatataaaaaaaaaaaaaaa

SEQ ID NO: 108 - protein, 449 aa, Triticum aestivum
MACTQENAMATDESTADHRGSRPSSHDMDLSGDDHVPKARKPYTITKQREKWTEEEHKRFLEALQLHGRAWRRIQEHIGTKTAVQIRSHAQKFFSKVTRESSGSCSGSGAAAATATAAIQIPPPRPKRKPTHPYPRKADDGAAAGGKHAPGLTHLERPPVRMGEQEEGSPTSVLTASRVEASGGRFSYNSSGSRSPVPSAAGSLYGSSVDRGDGCLSPNTTKASEFTANGDVKEGSCTGSATSVLKLFGKKVVVNDSFQKPNTSTGNPQNGGDVGTEASDDTTTQGSRNLPSGGATEGSSWNPWPSSMQQFVYFVPQPDGFATQSAVPWFGTLPGAMFYQQAMAPNQHQRHRSETADHKFMQREGSWTGSNTGPGSAAHNSDAADSRGRGNSSESDKTPVPRLTKCESSVSVSLQRGFMPYKRCAAESESLRSEAPREETDGELTRLCL

SEQ ID NO: 109 - DNA, 1501 bp, Glycine max
acgagagaagatcttgattcttgacaagagattgtttcttctgcagctatggcgattcaagatcaaaatggatttttcagatcacagggtggtcctccagaaggaggtggtgtatctttgagttctgggcattctgtcacacatattcaacttaatgaccagttttcttgtgggaatgactatgctctgaaggtaaggaagccgtatactatcactaaacagagagagcgatggacagatgaagaacataagaagttccttgaagctttaaagctgtatggacgggcttggcgacgtattgaagaacatgttggcacaaagactgctgttcagattcgaagtcatgctcagaagtttttttctaaggttcttcacgatcctactgggaacaatacaaacacagtggagtcaattgaaattcctcctccaagaccgaaacgaaagccgatgcatccttaccctcgtaaactagttgagaccccaaataaggaaatttcgatcccagaacaacctatgaagtctaattctctgaagtcgtcagactttgatcaagaaaaccaatctccaaaatcagtattatcaggagttggttcagacagccttggctcctctgattcagacacaccaaatggaagtttgtcgcccatgtcatccattagtggcttccatacaagcagttttacacgtgccaaacccaaaacaacaacatctgaggaagaagctgggatggacactgattcaactcatgatgagaaacctcttatgaaattcaagcttcctccaaatggatgtgtttccatcaaagaagacaacacagcagaagaatcttccggtcggactttcaaactctttggaatgactctatttgtaacagacacctgcaaaccatctccaacaatcgaggaatgctaaagatacctctaaacattcgcgcgcaacgcctttcctcctccatggaggatggcaaattggaacttgttggacactctagagcaagtgaaacatcagcaatatccaagctaaaggtgagagtggaacctgaagcatgtgggaaagggtttgtgccatataaaagatgcatatctgttgtgacagctgatgatagagaagagcaatgtatccatctttccttgtagcttataccccactggatttttccttcaaaaagtgttccctttgtcatgatgagctgtaatggttgttttggttgctgctggatgtgagttggtatgatataggaaggaaaaaggggtggctgaaaattttgatatttccgttgaattgcactgcactgcacattctccagctgttcaaatccgtaaacttgccttttctatttttttgacttccaagtttcaacacattctccgcgggtccaagccgtgtctgtgcgcggcacttaggagctgtgtccgtgcttcctagtttaactgtgaataactgtgaattatatctagtgccttttttttaaaaaaaaaaaaaaaaaaaaaaaaaaaactcg

SEQ ID NO: 110 - protein, 287 aa, Glycine max
MAIQDQNGFFRSQGGPPEGGGVSLSSGHSVTHIQLNDQFSCGNDYALKVRKPYTITKQRERWTDEEHKKFLEALKLYGRAWRRIEEHVGTKTAVQIRSHAQKFFSKVLHDPTGNNTNTVESIEIPPPRPKRKPMHPYPRKLVETPNKEISIPEQPMKSNSLKSSDFDQENQSPKSVLSGVGSDSLGSSDSDTPNGSLSPMSSISGFHTSSFTRAKPKTTTSEEEAGMDTDSTHDEKPLMKFKLPPNGCVSIKEDNTAEESSGRTFKLFGMTLFVTDTCKPSPTIEEC

SEQ ID NO: 111 - DNA, 479 bp, Glycine max
gtctctgtggaggtttgggtgttttttgaggcagagcttattctcattttgctccaatggagatgcaggaccaaatagaaagcacaagatcaaccatatttggctcagctagtaacatccattccaatgctgaaaagcaggccgaaaatgttgctcccaaggtgaggaaaccatataccattactaaacaaagggagaagtggacagaggaagagcatcaaaagttccttgaagctttgaaattgtatggtcgtggctggcgccaaattgaagagcatataggtaccaaaactgctgttcagattcgaagccatgctcaaaagtttttctctaaggttgtgagggaatctgaggtcagtgatgagggttctatacaaccaattaacatacctcctcctcggcctaagaggaaacccctgcatccatatccccgtaaatcagttaattctttcagaggacccaccataccaaatgaaaca

SEQ ID NO: 112 - protein, 141 aa, Glycine max
MEMQDQIESTRSTIFGSASNIHSNAEKQAENVAPKVRKPYTITKQREKWTEEEHQKFLEALKLYGRGWRQIEEHIGTKTAVQIRSHAQKFFSKVVRESEVSDEGSIQPINIPPPRPKRKPLHPYPRKSVNSFRGPTIPNET

SEQ ID NO: 113 - DNA, 1141 bp, Glycine max
  misc_feature (664)..(664): n is a, c, g, or t
  misc_feature (1101)..(1101): n is a, c, g, or t
tcattttctcggaaaattcttcttttccgagaaatttcgcgtttttactgttgaatcgataattcacaaatcgggggtgtctgaaattcaaagctgttgttgttgttggctgctggggttagtctctgtggaggtttgggtgttttctgaggcagagccgattctcattttgctccaatggagatgcaggtctcaatcatcttacgttcactcttctggagacttttctcctcttttaataggaaaaaagagaatttcaatatgaattcatccagtgactttatttctaaggaactgaaatatattctagaccaaatagaaagcacaagatcaaccatatttggctcagctagtaacatccattccaatggtgaaaagcaatccgaaaatgttgctcatataccttctgttggaaacaaccaaactcccaaggtgaggaaaccatataccattactaaacaaagggagaagtggactgaggaagagcatcaaaagttccttgaagctttgaaattgtatggtcgtggctggcgccaaattgaagagcatataggtaccaaaaatgctgttcagattcgaagccatgctcaaaagtttttctctaaggttgtgagggaatctgagggcagcgctgagagttctatacaaccaattaacatacctnctcctcggcctaagaggaaacccctgcatccatatccccgtaaatcagttaattctttcagaggacccaccataccaaatgaaacagaaatatctccatctacaaacctgttggttgcagagaaagacaccccatctccaacctcggtgctatctacagttggttcggaagcatttgggtctcaattttcagagcagactaacagatgcctttcaccaaactcttgcaccactgatattcactcagtcagcttatcacctgttgaaaaggaaaatgattgcatgacatccaaagaatctgaggaggaagagaaagcatcaccagcttcacgtcctttatccactgtttctaacccaaaaatgtgcatgaaacctgagtttagttccaaggagatagaagatgctactgatatgccacaaaccactagtattaagctntttggaagaacagtctctatggtaggtaatcagaagtcac

SEQ ID NO: 114 - protein, 321 aa, Glycine max
  UNSURE (163)..(163): Xaa can be any naturally occurring amino acid
MEMQVSIILRSLFWRLFSSFNRKKENFNMNSSSDFISKELKYILDQIESTRSTIFGSASNIHSNGEKQSENVAHIPSVGNNQTPKVRKPYTITKQREKWTEEEHQKFLEALKLYGRGWRQIEEHIGTKNAVQIRSHAQKFFSKVVRESEGSAESSIQPINIPXPRPKRKPLHPYPRKSVNSFRGPTIPNETEISPSTNLLVAEKDTPSPTSVLSTVGSEAFGSQFSEQTNRCLSPNSCTTDIHSVSLSPVEKENDCMTSKESEEEEKASPASRPLSTVSNPKMCMKPEFSSKEIEDATDMPQTTSIKLFGRTVSMVGNQKS

SEQ ID NO: 115 - DNA, 470 bp, Glycine max
acgagaactagtctcgagtttttactgttgaatcgataattcacaaatcgggggtgtctgaaattcaaaggaccaaatagaaagcacaagatcaaccatatttggctcagctagtaacatccattccaatggtgaaaagcaatccgaaaatgttgctcatataccttctgttggaaacaaccaaaactcccaaggtgaggaaaccatataccattactaaacaaagggagaagtggactgaggaagagcatcaaaagttccttgaagctttgaaattgtatggtcgtggctggcgccaaattgaagagcatataggtaccaaaaatgctgttcagattcgaagccatgctcaaaagtttttctctaaggttgtgagggaatctgagggcagcgctgagagttctatacaaccaattaacatacctcctcctcggcctaagaggaaacccctgcaatccatattcccccgt

SEQ ID NO: 116 - protein, 114 aa, Glycine max
MVKSNPKMLLIYLLLETTKTPKVRKPYTITKQREKWTEEEHQKFLEALKLYGRGWRQIEEHIGTKNAVQIRSHAQKFFSKVVRESEGSAESSIQPINIPPPRPKRKPLQSIFPR

SEQ ID NO: 117 - DNA, 1297 bp, Glycine max
acgaggaaagccttatactatcaccaaacagagagagcgatggacagatgaagaacataagaagttccttgaagctttaaagctgtacggacgggcttggcgacgtattgaagaacatgttggcacaaagactgctgttcagattcgaagtcatgctcagaagtttttttctaagcttcttcgcgatcctactgggaacaatacaaacacagtggagtcaattgaaattcctcctccaaggccgaaacgaaagccagtgcatccttaccctcgtaaactagttgagacccctaataaagaaattttgatcccagaacaacttatgaagtctaattctctgaagtcatcagactttgatcaagaaaaccaatctccaaaatcagtattatcaggagttggttcagacagccttggctcctctgattcagacacaccatatggaagtttgtcgcccatgtcatccattagtggcatccatacaagcagttttacacgtgctgagcacaaaacaacatctgatgaagctgggatggacactgattcagctcatgatgagaaacctcttatgaaattcaagcttcctccaaatgaatgtgtttccatcaaagatgacacagcagaagaatcttccggtcggactttcaaacttttcggaatgactctatttgtaacagacacctgcaaaccatctccaacaatcgaggcatgcaaaccgatacctctaaacattcgtgtgcgatgcctttcctcctccatgggggatgatggcaaattggaacttcgtggccactctacagcaagtgaaacatcagcaatatccaagctaaaggtgagagtgggacctgaagcatgtggtaaagggtttgtgccatataaaagatgcatatctgttgtgacagctgataatagagaagagcaatgcatccatctttccttgtagcttaccccactggatatttcttcaaaagggttccctttgagatgatgagctgtaatggttgttttagctgctggatgtgagttggcataaaatagggagctgaaaattttgacatttctgttgcattacactgcacattctccagctgttcaaatccgtgaacttgccttttgtatttttttgactttcaagtttcaactgtgaattatatctagtgtttttgtttgtttttttttaaaaactttttatgctccttaagagtatgcaaagtgtaagtcacgtacttgtgcagtgcttattaacgtacttgttcatagattctgcatttactaccatgatgggaattttttctaacga

SEQ ID NO: 118 - protein, 312 aa, Glycine max
RGKPYTITKQRERWTDEEHKKFLEALKLYGRAWRRIEEHVGTKTAVQIRSHAQKFFSKLLRDPTGNNTNTVESIEIPPPRPKRKPVHPYPRKLVETPNKEILIPEQLMKSNSLKSSDFDQENQSPKSVLSGVGSDSLGSSDSDTPYGSLSPMSSISGIHTSSFTRAEHKTTSDEAGMDTDSAHDEKPLMKFKLPPNECVSIKDDTAEESSGRTFKLFGMTLFVTDTCKPSPTIEACKPIPLNIRVRCLSSSMGDDGKLELRGHSTASETSAISKLKVRVGPEACGKGFVPYKRCISVVTADNREEQCIHLSL

SEQ ID NO: 119 - DNA, 969 bp, Ostreococcus tauri
ggcgaggccccatcgagtaatgataccggtgatgaggccacggtgacgacgaacgacgccacgagcgatccgacgacgacggaggggaaggcggtgaagacgcgcaagccgtacaccattacgaagaagcgcgagcgatggtccgacgaggagcacgcgttgttcgtagagtcgttaaaaaagtacggacgcgcttggaaaaggattgaggagtacattgggacgaagagtgcggtgcaaattcggtcgcacgcgcagaaatttttcgccaagctacaaaaggagcagatcgtcgcgagcggaagcgagggctctgggagcacgcgaaagcgtggagcggatcgatcgacgtcgcagagcaagagaagcaagtctagctatgcgacggatatcaatcttgagattccgccggcgcggcctaagaagaagccggcgcatccgtacccgaggaaggcgacgtctcagcagccgagcggcggaagcggagagcgagacaactctggtgggactggtaagagctccggtacggcgcaaaagtggcctaccgaggcgagtcaggagtttatcgctagtacgtcgtcgagcgccgcgatagcagccgtgctttcggtcgcttgcgataagatgcagaacaatttgcatcaagagttgcggcaaggatattttggaataccgaccggcatgcaaccgcagcagggaatgtttgcccagcctgggatgtttccgatgaacgcgatgatgagtccgttcgtggcgatgaacaccgtctccggcgcgccgacaccgccgccgatgaccaatccacagcaatttcttaactacgccaacttcttcagcaactattggcctcagttcgccaacgccgctaacgccaacgctgtgaatgtgatgttccaacaacaacagcaacagcaacagcaacagcaacaacaacaacataaacagcgggcgggtggtgaaaccaaataa

SEQ ID NO: 120 - protein, 322 aa, Ostreococcus tauri
GEAPSSNDTGDEATVTTNDATSDPTTTEGKAVKTRKPYTITKKRERWSDEEHALFVESLKKYGRAWKRIEEYIGTKSAVQIRSHAQKFFAKLQKEQIVASGSEGSGSTRKRGADRSTSQSKRSKSSYATDINLEIPPARPKKKPAHPYPRKATSQQPSGGSGERDNSGGTGKSSGTAQKWPTEASQEFIASTSSSAAIAAVLSVACDKMQNNLHQELRQGYFGIPTGMQPQQGMFAQPGMFPMNAMMSPFVAMNTVSGAPTPPPMTNPQQFLNYANFFSNYWPQFANAANANAVNVMFQQQQQQQQQQQQQQHKQRAGGETK

SEQ ID NO: 121 - DNA, 330 bp, Medicago truncatula
atggatgcagcagcatactcctctggagaagacgtcgttctcaagacaagaaagccatatacaatcacaaaacaaagagaacgatggactgaagacgaacataatcgatttctagaagccctcaagctatatggccgagcatggcagcgtatagaagaacatataggaacaaagactgctgtgcaaatcaggagccatgcgcaaaaattcttttcaaaggtcgattggtaccctctctcacctcccaatttatgctcaaactttttcttatttctattgggaaaaaactcaagtcccacatcggatataagactcttgatgggagtatag

SEQ ID NO: 122 - protein, 109 aa, Medicago truncatula
MDAAAYSSGEDVVLKTRKPYTITKQRERWTEDEHNRFLEALKLYGRAWQRIEEHIGTKTAVQIRSHAQKFFSKVDWYPLSPPNLCSNFFLFLLGKNSSPTSDIRLLMGV

SEQ ID NO: 123 - DNA, 1343 bp, Malus x domestica
tttcaatttaaaaaaaaaccaaggggaatccgactcttccgcaatttatggtatccaaaaacccgaacccgccagagggcttgtacttggatccgaacgaaagcggcatgccgttgcccggactcgggccgttcgcctcggccactgcgacgacgtcaacgacttcgtcttcggcggaggatctgagcaagaagattcggaagccctacacaattaccaagtccagagagagctggagtgagccggagcacgacaagttcctcgaagccctccaactcttcgatcgcgattggaaaaagattgaagctttcattgggtcaaagacggtcatacagatacgtagtcatgcacagaagtattttctgaaggttcaaaagaatgggacgagcgagcatctacctccccctaggccaaaaaggaaagctgctcacccatatcctcaaaaagcttcaaaaaatgctctggcacttccgccagtatcttggtcatgtcagtcttcatctgctttacttgaatctgggtttaatcaaaggccagattcatcatcaatgcttatgagtcctatccctggccctgtagccccttcctggcctaatggttctgtgcaaacagccaatccatctcatgagtccaaagttgtttcagggccaactgtgctgaacaacagttgcagtaccacagaaagcacccctaaagctcaaccagttggtggaacaactgatcaagtgaaccatagccatgcattgagagttcttcccgactttactcaagtatacggattcattggcagcgtctttgaccctaatgttacaggtcatcttcagaatctgaagaagatggatccgatagatgttgaaacggtgttactgttgatgagaaacctgtccatgaatttgaccaatcccgaattcgaggatcatagacagttgctttcatcctacaagatggacgcgaatacagggaatctcagtgatgcaactaaaaccctttgcgacgatcaacatgagaaagttccttaagtggttgttctgaaacttcaacgctttcttctcatcccgttggcagtgcttgaatttcgaatctaatctttgcccaaccggtgttggcgtccagcagatgaattgctgggggaaaacctcaattagtagaaagcatcaggtttcatctaggtattgactcgtcgtgatactgcgttgtaagtgtagcgagctcaacgaccacaagcatgtcaactggtatggcgttctggtgtggttgtgtgtgtgtgtgtatatatatatatcaagataaaggtaatggatttttgtatagttagttcaagttcatcttgtaaaaaaaaaaaa

SEQ ID NO: 124 - protein, 323 aa, Malus x domestica
MVSKNPNPPEGLYLDPNESGMPLPGLGPFASATATTSTTSSSAEDLSKKIRKPYTITKSRESWSEPEHDKFLEALQLFDRDWKKIEAFIGSKTVIQIRSHAQKYFLKVQKNGTSEHLPPPRPKRKAAHPYPQKASKNALALPPVSWSCQSSSALLESGFNQRPDSSSMLMSPIPGPVAPSWPNGSVQTANPSHESKVVSGPTVLNNSCSTTESTPKAQPVGGTTDQVNHSHALRVLPDFTQVYGFIGSVFDPNVTGHLQNLKKMDPIDVETVLLLMRNLSMNLTNPEFEDHRQLLSSYKMDANTGNLSDATKTLCDDQHEKVP

SEQ ID NO: 125 - DNA, 1419 bp, Triticum aestivum
gcacgagcccaacccggcccccggcgccacaccgcgacgcgacgcgacgcagccaccacgcaggcggacgcggccgagctacggacaaaagcctccctctccatcccccggtccagcgagcgagagaccgccaccggcaccggcacccaacgggacctggcacgccgcgcgccctctggcctccgtgcgtcccccatggtctccacgaacccgccgccgccgccggcgctgtccgaggcggccgccgccgtgtcgggcgacgacgccagcaagaaggtgcggaagccctacaccatcaccaagtcgcgcgagagctggacggagcaggagcacgacaagttcctcgaggccctgcagctctttgatcgtgactggaaaaagatagaagcttttgttggttcgaagactgtcatccagataaggagccatgcacagaagtattttttgaaggttcagaaaaatggaaccagcgaacatgtcccacctccacgaccgaagcgtaaagctgcccacccataccctcagaaggcctccaaaaatgagccaggatatgccctgaagacagatccatctgccatgcttagaaattcaggaatgaacgtggctgtttctccatggacccacaattctatcccaccagttgtcgcctcatctttcatgaaagaagatttaggtgctgggtctatgggtccaaacattttttgctcaagcagtagtgaaggccctccaagggcatggcaatctggtgaaaccaatgaccagataaatcaagttccatcactccgcattatgccagattttgcacaagtatacagcttcttaggcagtgttttcgatccaagcacaaagggccatttgcagaaactgaaggagatgaatccaattgatgttgaaacagcactgttgttaatgagaaatctctccatcaacttgaccagtcctgattttgaagatcaaaggaagttgctgtcttcgtacaattccacctctgatgggctagagctagggagctccagaagctcacttcttacggataatgcattgagccttttttgatagttcatgattaaaggcagatggtgccgcctatagtttcatctcgatctctgaatagggggttttcctggagcacccatgaaggcgctttcaccattgtatttctagctagcttcgaaccgtagaatgtgtaagggtgcaaccatgtacagtaggcttccataaggtgagatctgtctatagcctgatgtgtatatattttcgccccgaagcgtgtatctttcctcccccgataccttggccatcaaggtgcatggatgttgcttcagtcaaagcttgaaagtgctgtccttggtgatggtaaatggaaaggaaattttgagtaatgctggttactcccttttcaaaaaaaaaaaaaaaaaa

SEQ ID NO: 126 - protein, 286 aa, Triticum aestivum
MVSTNPPPPPALSEAAAAVSGDDASKKVRKPYTITKSRESWTEQEHDKFLEALQLFDRDWKKIEAFVGSKTVIQIRSHAQKYFLKVQKNGTSEHVPPPRPKRKAAHPYPQKASKNEPGYALKTDPSAMLRNSGMNVAVSPWTHNSIPPVVASSFMKEDLGAGSMGPNIFCSSSSEGPPRAWQSGETNDQINQVPSLRIMPDFAQVYSFLGSVFDPSTKGHLQKLKEMNPIDVETALLLMRNLSINLTSPDFEDQRKLLSSYNSTSDGLELGSSRSSLLTDNALSLF

SEQ ID NO: 127 - DNA, 633 bp, Glycine max
gtcgctccccggaatccttcccttcgccgccgcagccaccgccaccgcagattcctttgaggaccctgctaagaagactcgcaagccttacactattaccaagtctagggagagttggaccgaacctgagcacgacaagttcctcgaagctcttcagttatttgaccgtgactggaaaaagattgaagcatttgttggatcaaagacagtcatccagatacgtagccatgctcagaaatactttctaaaagttcagaagagtgggacaaatgaacatcttcctccacccagaccaaaaagaaaagctgctcatccatatcctcagaaagcttcaaaaactggttatagtcttcactatattttttttttttgctacacaatttagtgcatttgtctctaataattgttggtgagatttggcagctccagtactctcacaagtatcaggatcctttcaatcttcatcagctttgcttgaacctggatacatattaaagcatgactcttcagcaatgcctaaaactcccattattaacactgcagtgtcttcctggtcaaacaactctctgcagaaaaccaccagcgtattgcatgggcaaaaacaaaaagtgaataattgttgcagtagcagta

SEQ ID NO: 128 - protein, 127 aa, Glycine max
SLPGILPFAAAATATADSFEDPAKKTRKPYTITKSRESWTEPEHDKFLEALQLFDRDWKKIEAFVGSKTVIQIRSHAQKYFLKVQKSGTNEHLPPPRPKRKAAHPYPQKASKTGYSLHYIFFFCYTI

SEQ ID NO: 129 - DNA, 646 bp, Glycine max
taaacttggacccctccggcatgtcgctccccggaatccttcccttcgccgccgcagccaccgccaccgcagattcctttgaggaccctgctaagaagactcgcaagccttacactattaccaagtctagggagagttggaccgaacctgagcacgacaagttcctcgaagctcttcagttatttgaccgtgactggaaaaagattgaagcatttgttggatcaaagacagtcatccagatacgtagccatgctcagaaatactttctaaaagttcagaagagtgggacaaatgaacatcttcctccacccagaccaaaaagaaaagctgctcatccatatcctcagaaagcttcaaaaactgctccagtactctcacaagtatcaggatcctttcaatcttcatcagctttgcttgaacctggatacatattaaagcatgactcttcagcaatgcctaaaactcccattattaacactgcagtgtcttcctggtcaaacaactctctgcagaaaaccaccagcgtattgcatgggcaaaaacaaaaagtgaataattgttgcagtagcagtagaagtcctagagcgcagttggttggtgaatctaatggtcaaaggaataacagccatccattgagagttcttcc

SEQ ID NO: 130 - protein, 215 aa, Glycine max
NLDPSGMSLPGILPFAAAATATADSFEDPAKKTRKPYTITKSRESWTEPEHDKFLEALQLFDRDWKKIEAFVGSKTVIQIRSHAQKYFLKVQKSGTNEHLPPPRPKRKAAHPYPQKASKTAPVLSQVSGSFQSSSALLEPGYILKHDSSAMPKTPIINTAVSSWSNNSLQKTTSVLHGQKQKVNNCCSSSRSPRAQLVGESNGQRNNSHPLRVLP

SEQ ID NO: 131 - DNA, 206 bp, Pisum sativum
  misc_feature (13)..(13): n is a, c, g, or t
  misc_feature (18)..(18): n is a, c, g, or t
tttacaaagcagngaganaggtggacagatgaagaacataagaagttccttgaagctttaaagctgtatggccgagcctggcgaaaaatcgaagaacatgttggcacaaagactgctgtgcagattcgaagtcatgctcagaagtttttttctaagatcaatcgagacactaatgggaacgatacgacattggtggagtcaattga

SEQ ID NO: 132 - protein, 68 aa, Pisum sativum
  UNSURE (5)..(6): Xaa can be any naturally occurring amino acid
FTKQXXRWTDEEHKKFLEALKLYGRAWRKIEEHVGTKTAVQIRSHAQKFFSKINRDTNGNDTTLVESI

SEQ ID NO: 133 - DNA, 1577 bp, Glycine max
  misc_feature (1573)..(1573): n is a, c, g, or t
gggacgagcaaatcgaaagacaagagtcacagcgcacccccaaacagaaacagagttattgggagcacgaaacactaactgactcgattcgattgaggttacaaaacactaaactgattcgattcgattcgattgaggtttcggtttggtcttgatggtgtcggtgaacccaagccctgctcaaggcttctacttcttcgatccctccaacatggtccttcccggcgtcaacaatcttccaccgcccccgccgcctgctccgccttctcacgccgccgtggaggatccgagtaagaagatcaggaaaccctacacgattaccaagtccagggagagctggactgagcaggagcacgacaagtttctagaagctctccaattatttgatcgggactggaaaaagattgaagcatttgttggttcaaaaacagttatccagatacgaagtcatgcacagaagtattttcttaaagttcagaagaagggaacaagtgaacatgtacctcctccccggccaaagagaaaagctgctcgcccataccctcaaaaagctcctaaaactcctactgtatcccaagttatgggcccattgcaatcttcatcttctttcattgaacctgcatacatttatatcccggattcttcatctgcgcttggaactccagttactaacatgccttcgtcatcttggaactataataatacaccacaatctgtcaatgtgccacaagtgaccagagatgacatgggattcactgtagctggacaaacagctcctcttaattgttgctgcagcagtagtaatgagagcacccctccaacttggccaagtagcaaaaggactaatcaaggtgaccaggagccaattaaagtaatgccagattttgcacaagtctacagcttcatcggcagtgtattcgatccaaattcaactaatcacctacagaaactacgacagatggatccattaaatgtggaaacgatattgttgttgatgagaaatctctccatcaatttaatgagtcctgaatttgaggatcacaagaggctgctttcttcatatgacaccgactctgacaagtcgaagttggttaatatttgcagcaaatccctcactaataaatctgagagtgctgttttgtctgcttaggatgtggccagtggtttgccctcaatatattttctgaatgcacataaagtgggagcaagaaggggagaagacataggttttgctaaaaggaagtgtagtatctagatgcttgcaagttgaatgtgtatataactatatataaatatatgtatacattttggattgagtttttgtttgttttaggcactgttagatcgtagatatgctggtgtgtttggtgtatatctttcgaagatatgatgattgtccttggaatgcaggacaatgagagtcctgttaggtcacttctggaggctatactgtacagtctgttgagtgcttttgtttattatgctgtgaagcataggattagtataaaagagtggtgttaggacttaggggtgccgcgttgtatatataaagcaataaaacagtgcagataantttc

SEQ ID NO: 134 - protein, 331 aa, Glycine max
MVSVNPSPAQGFYFFDPSNMVLPGVNNLPPPPPPAPPSHAAVEDPSKKIRKPYTITKSRESWTEQEHDKFLEALQLFDRDWKKIEAFVGSKTVIQIRSHAQKYFLKVQKKGTSEHVPPPRPKRKAARPYPQKAPKTPTVSQVMGPLQSSSSFIEPAYIYIPDSSSALGTPVTNMPSSSWNYNNTPQSVNVPQVTRDDMGFTVAGQTAPLNCCCSSSNESTPPTWPSSKRTNQGDQEPIKVMPDFAQVYSFIGSVFDPNSTNHLQKLRQMDPLNVETILLLMRNLSINLMSPEFEDHKRLLSSYDTDSDKSKLVNICSKSLTNKSESAVLSA

SEQ ID NO: 135 - DNA, 786 bp, Glycine max
acgagggacgagcgaaacccaagacaagaatcacagcgcacagtgacacatacataaaaaaacgaaacacaaacagaaacagagttattgggaaacacgaaacactaattgattcgaattcgattcgattgaggattgctgtttgggtgtcttgatggtgtcggtgaacccaaaccccgctcaaggcttctacttcttcgatccctccaacatgacccttcccggcgtcaacaatcttccaccgccgccgccgccggctccggctgctccctccgccgtcgaggatccgaataagaagatccggaaaccctacacgattaccaagtccagggagagctggaccgagcaggagcacgacaagtttctagaagctctccaattatttgatcgggactggaaaaagattgaagcatttgttggttcaaaaacagttatccagatacgaagtcatgcacaaaagtattttcttaaagttcagaagaatggaacaagtgaacatgtacctcctcctcggccaaagagaaaagctgctcacccataccctcaaaaagctcctaaaactcctactgtatcccaagttatgggcccattgcaatcttcatctgctttcattgaacctgcatacatttatagcccagattcttcatctgtgcttggaactccagttactaacatgcctttatcatcttggaattataatactacaccacaaccaggcaatgtgccacaagtgaccagagatgacatgggattgactggagctggacaagctgctcctcttaattg

SEQ ID NO: 136 - protein, 210 aa, Glycine max
MVSVNPNPAQGFYFFDPSNMTLPGVNNLPPPPPPAPAAPSAVEDPNKKIRKPYTITKSRESWTEQEHDKFLEALQLFDRDWKKIEAFVGSKTVIQIRSHAQKYFLKVQKNGTSEHVPPPRPKRKAAHPYPQKAPKTPTVSQVMGPLQSSSAFIEPAYIYSPDSSSVLGTPVTNMPLSSWNYNTTPQPGNVPQVTRDDMGLTGAGQAAPLN

SEQ ID NO: 137 - DNA, 587 bp, Glycine max
  misc_feature (420)..(420): n is a, c, g, or t
  misc_feature (529)..(529): n is a, c, g, or t
atgcactagagaagggtgagaaagggaaggaagagcctgaaacacctgatgctaaccaattagccattgactttagtaatcgtcgtagaagtgttagcaatcttactgattcttggaaagaggtctctgaagaggggagactggcctttcaggctctattctccagagaggtgttgcctcaaagcttttcacctcctcatgctttgaagaataagaatcagcaaatggacaacgccaataataacaagcaaaacatagaaaataacgagggactgttaaccatagggcttggacaaggaaagcttaagactcgtcgaacaggctttaaaccctacaaaagatgttccatggaggccaaggaaaatagggttggagcgagcaacaatcaaggtgaagagcaaggttgtaagagaatacgtntggaaggggagacttcgacttgaggtttgatatatgcagtaacataaatgcaacctttgggttttacatgtcatttcttaatccccccacaacggtgtaactatattgnttatttctaattctgcagctcaccgaaactgtcgtgtagatgtggtgtccattttgaa

SEQ ID NO: 138 - protein, 146 aa, Glycine max
  UNSURE (140)..(140): Xaa can be any naturally occurring amino acid
ALEKGEKGKEEPETPDANQLAIDFSNRRRSVSNLTDSWKEVSEEGRLAFQALFSREVLPQSFSPPHALKNKNQQMDNANNNKQNIENNEGLLTIGLGQGKLKTRRTGFKPYKRCSMEAKENRVGASNNQGEEQGCKRIRXEGETST

SEQ ID NO: 139 - DNA, 1187 bp, Glycine max
ctgcttcccacgccacatcgttctccctctccctccctctctctctctctctctctctctctctctctctaagctctttcttgttgaaactgtgagtctatgttatttgtggcggagcatgaactccaccaccaacacttcgaattctcagtcaatggctgcagcagcaccgagtgatggttctgggaagaaggtaagaaagccttacaccataaccaagtccagagagagttggactgaggaagaacatgataagtttctcgaagctctccaactatttgacagggactggaagaaaattgaagattttgtaggttcaaaaacagttattcagattcgaagccatgcccagaaatacttcttgaaagttcaaaagaatgggactgtggcacatgtgcctcctccccgtccaaagcgcaaagctgctcatccttacccgcaaaaggcatcaaaaaatgttttggtgccactaccagcttccattggttatgcttcatcgagaaatacgcttgcacctgggtttgcctcatgggatgaaacttccctgctgatgaatgctggagccgataaacccatgacctgtcaggatgaactcaacaatcttcatcatggaaatgaagctgatattggatcaaaggggatagcacagattaccaacagcagtctcagtggtgttggaaattctactagaacactactgacttctgagataccaaagcaagggaaacaagctccagtgcttcatggtttgccagattttgctgaagtttacggtttcattggaagtgtatttgatccagaaacaaatgaccatgtccagaagctgaaggaaatggatcctataaattttgaaactgttttgttgctaatgagaaacctcactgtcaacttgtctagccctgacttcgaacccatttgatagaatggggagacatcccaatactactgggcaaggcgccaatgacccacccaaaagattactgcacaagcttaaaccacaagtaatttgacaactactcaattagtacctagacgtcaagggatctctctgagaaggccccagagtgttctctttttctaattacatgtgaatgacgtgataggatttccatgtaataaatataggctcttgtattaatttgtgattagccccggattacttgaaaaattaaagtatttattagata

SEQ ID NO: 140 - protein, 266 aa, Glycine max
MNSTTNTSNSQSMAAAAPSDGSGKKVRKPYTITKSRESWTEEEHDKFLEALQLFDRDWKKIEDFVGSKTVIQIRSHAQKYFLKVQKNGTVAHVPPPRPKRKAAHPYPQKASKNVLVPLPASIGYASSRNTLAPGFASWDETSLLMNAGADKPMTCQDELNNLHHGNEADIGSKGIAQITNSSLSGVGNSTRTLLTSEIPKQGKQAPVLHGLPDFAEVYGFIGSVFDPETNDHVQKLKEMDPINFETVLLLMRNLTVNLSSPDFEPI

SEQ ID NO: 141 - protein, 18 aa, Artificial sequence
  motif 1
  VARIANT (2)..(2): Xaa is Thr or Ser
  VARIANT (3)..(3): Xaa is Glu, Asp, Ala, Pro, Thr or Arg
  VARIANT (4)..(4): Xaa is Gly, Glu, Pro, Gln, Asp, Ala, Asn or Tyr
  VARIANT (6)..(6): Xaa is His or Gln
  VARIANT (7)..(7): Xaa is Asp, Glu, Asn, Arg, Lys, Gln, Ala or Ser
  VARIANT (8)..(8): Xaa is Lys, Arg, Leu, Met, Thr, Asn or Gln
  VARIANT (10)..(10): Xaa is Leu, Ile, Val, or Met
  VARIANT (11)..(11): Xaa is Glu, Asp, Gln, Ile, Leu, Val, Met, Thr, Ala, Arg or His
  VARIANT (12)..(12): Xaa is Ala, Ser or Gly
  VARIANT (13)..(13): Xaa is Leu, Ile or Met
  VARIANT (14)..(14): Xaa is Gln, His, Ile, Lys, Arg, Ser, Asp, Glu or Asn
  VARIANT (15)..(15): Xaa is Leu, Met, Lys, Arg, Gln, Val or Thr
  VARIANT (16)..(16): Xaa is Phe, Tyr, His, Val or Leu
  VARIANT (17)..(17): Xaa is Asp or Gly
  VARIANT (18)..(18): Xaa is Arg, Lys or Glu
WXXXEXXXFXXXXXXXXX

SEQ ID NO: 142 - protein, 19 aa, Artificial sequence
  motif 2
  VARIANT (1)..(1): Xaa is Phe, His, Tyr, Cys or Leu
  VARIANT (2)..(2): Xaa is Val or Ile
  VARIANT (3)..(3): Xaa is Gly, Ala, Lys, Thr, Val, Ser or Arg
  VARIANT (4)..(4): Xaa is Ser or Thr
  VARIANT (5)..(5): Xaa is Lys or Arg
  VARIANT (6)..(6): Xaa is Thr, Asn or Ser
  VARIANT (7)..(7): Xaa is Val, Thr, Ala, Pro or Ser
  VARIANT (8)..(8): Xaa is Ile, Val, Thr, Met, Arg, Glu or Ala
  VARIANT (10)..(10): Xaa is Ile or Val
  VARIANT (11)..(11): Xaa is Arg, Ala or Ser
  VARIANT (12)..(12): Xaa is Ser or Met
  VARIANT (13)..(13): Xaa is His or Tyr
  VARIANT (14)..(14): Xaa is Ala or Tyr
  VARIANT (15)..(15): Xaa is Gln or Asp
  VARIANT (16)..(16): Xaa is Lys, Tyr or Asn
  VARIANT (17)..(17): Xaa is Tyr, His or Phe
  VARIANT (18)..(18): Xaa is Phe, Lys or Cys
  VARIANT (19)..(19): Xaa is Leu, Thr, Ser, Ala, Ile, Arg or His
XXXXXXXXQXXXXXXXXXX

SEQ ID NO: 143 - protein, 6 aa, Artificial sequence
  motif 3
  VARIANT (3)..(3): Xaa is Pro or Gln
  VARIANT (4)..(4): Xaa is Arg, Tyr or Leu
  VARIANT (5)..(5): Xaa is Pro or His
  VARIANT (6)..(6): Xaa is Lys, Arg or Pro
PPXXXX

SEQ ID NO: 144 - protein, 11 aa, Artificial sequence
  motif 4
  VARIANT (7)..(7): Xaa is Ser or Thr
ATVAAAXAWWA

SEQ ID NO: 145 - protein, 9 aa, Artificial sequence
  motif 5
  VARIANT (5)..(5): Xaa is Cys or Ser
DRSSXGSNT

SEQ ID NO: 146 - DNA, 2193 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 147 - DNA, 56 bp, Artificial sequence
  primer: prm07263
ggggacaagtttgtacaaaaaagcaggcttaaacaatggagacaaattcgtctgga

SEQ ID NO: 148 - DNA, 53 bp, Artificial sequence
  primer: prm07264
ggggaccactttgtacaagaaagctgggtgaaaatagagtctcatgtggaagc

SEQ ID NO: 149 - DNA, 1496 bp, Arabidopsis thaliana
atggccacaacgatgacacgtgtctccgtcggcgtcgtcctctttgttctcttagtctcgctggttgccgtctccgccgcgagaagcggtcctgatgatgttatcaaactcccttcgcaggcttctcgcttcttccgtcctgctgaaaacgacgacgattctaactccggtactaggtgggctgttctagtcgccggatctagcggatattggaattacaggcatcaggctgatatatgccatgcctatcaacttctgaggaaaggtggattgaaagaggagaatattgtggtattcatgtatgatgatattgctaacaattacgagaatccaaggcctggaaccattatcaacagccctcatggaaaagatgtctatcaaggagttcccaaggattatactggagatgatgtcaatgttgataatctatttgctgtgatccttggagacaaaactgctgttaaagggggaagtgggaaggttgtggatagtggtcctaatgatcatatcttcatattctacagtgaccatggtggtcctggagttcttgggatgccaacttctccttacctatatgcaaatgatctcaatgatgtcttgaagaagaaacatgctttaggaacatataaaagcttggtgttttatctcgaagcttgcgaatctggaagtatctttgaagggcttcttcctgagggtttgaacatctatgccacaactgcatcaaacgccgaagaaagcagttggggtacctattgccctggagaggaacccagtcctccaccggagtatgaaacttgtttaggtgacttgtacagtgttgcttggatggaagatagtggtatgcacaatttacagactgagactctgcaccagcaatatgaacttgtgaaaaggaggactgcacctgttgggtactcttatggttctcatgtcatgcaatatggcgatgtaggaattagcaaggataatctcgatctttatatgggaacaaaccctgccaatgacaattttacctttgcggatgcgaattcactaaagccaccttcaagagttacaaaccagcgtgatgcagatcttgttcatttttgggaaaagtaccgaaaagcaccagaaggttcagcaagaaaaacagaagctcagaagcaagtacttgaagccatgtctcacagacttcatattgacaatagcgtgatactcgtcggaaaaatcttgtttggcatttcgagaggtcctgaagtgctaaacaaagtacggtctgctgggcaacctctagtcgatgactggaactgccttaaaaatcaggtgagagctttcgagaggcactgtggatcgctgtctcagtacggtatcaagcacatgaggtcttttgcaaacatctgcaatgcagggattcaaatggagcaaatggaggaggcagcttcacaggcttgtaccacactgccaactggtccttggagctcgcttaaccgtggattcagtgcatagaaaccctaaac

SEQ ID NO: 150 - protein, 494 aa, Arabidopsis thaliana
MATTMTRVSVGVVLFVLLVSLVAVSAARSGPDDVIKLPSQASRFFRPAENDDDSNSGTRWAVLVAGSSGYWNYRHQADICHAYQLLRKGGLKEENIVVFMYDDIANNYENPRPGTIINSPHGKDVYQGVPKDYTGDDVNVDNLFAVILGDKTAVKGGSGKVVDSGPNDHIFIFYSDHGGPGVLGMPTSPYLYANDLNDVLKKKHALGTYKSLVFYLEACESGSIFEGLLPEGLNIYATTASNAEESSWGTYCPGEEPSPPPEYETCLGDLYSVAWMEDSGMHNLQTETLHQQYELVKRRTAPVGYSYGSHVMQYGDVGISKDNLDLYMGTNPANDNFTFADANSLKPPSRVTNQRDADLVHFWEKYRKAPEGSARKTEAQKQVLEAMSHRLHIDNSVILVGKILFGISRGPEVLNKVRSAGQPLVDDWNCLKNQVRAFERHCGSLSQYGIKHMRSFANICNAGIQMEQMEEAASQACTTLPTGPWSSLNRGFSA

SEQ ID NO: 151 - DNA, 1637 bp, Triticum aestivum
  misc_feature (14)..(14): n is a, c, g, or t
ggcggcagagcagnctgactgaagcagagagcagcagttcaccatggctcgcctttcctgctcacccctcctcctcctcctcttcttgtcgtcgcagctcgccctgctcgtcgccggcgagttcctccgcctgccgtccgagaaggacgtcgtcgggacgagatgggccgtcctcatcgccggctccaacggctactacaactaccgccaccaggcggacgtatgccacgcgtaccagatcatgaagaagggcgggctgaaggacgagaacatcatcgtcttcatgtacgacgacatcgccggcaaccgcgacaaccccaggcctggggtcatcatcaaccaccccaaaggcggcgacgtctacgccggagtccccaaggactacacgggggcagacgtcaacgccaacaacttcctcgccgcgctgctcggcgacaagtccaagctcaccggcagcggcagcggcaaggtcgtcagcagcggcccggacgaccacatcttcgtctattacgccgatcacggtggcccagggatccttgggatgccgggcgacgaggagtacctgtacgcgaacgacctggtgcggacgctggagaagaagcacgccggcggggccgggtataagagcctggtcttctacctggagggcctgcgagtccgggagcatcttcgagggcctcctcccgggcaacatcagcgtgtacgccaccacggcggccaacgcggaggagagcagctggggcacctactgccccggcgacgacgagggcgccccgccgccggagtacgacacctgcctcggcgacctctacagcgtcgcctggatggaggacagcgacgcgcacaacctcaacgccgagtcccttaagctgcagtacgagcgggtcagggaccggacgtcggcgggcggcacgtacagcctcggctcccacgtcatgcagtacggcgacctgggcctcaacgaccagagcctcttcgtctacatcggcaccaaccctgccaacgacaacgcctccttcgtccagggctcctcctcgacctccaggcagctgccgggcggcggagtgaaccagcgggacgccgacctcgtccacttctggcacaagtaccggagtcggcggaggggtcggccgagaaaggcgaggcgcggaggcggctggtggagacgatggcgcggcggtctcgcgtggacagcagcgtggagctcatcggcggcctcctcttcggctcagaggaaggtgccaaggtcctcggcgccgtgcggccggcggggcagcctgtggtggatgactgggactgcctcaagtctgtggtgcggacgttccagcagcggtgcgggccgctgacgcagtacgggatgaagcacatgcgctcgctcgccaacctctgcaacgccggcgtccgggaggaggccatggacaaggctgcggctcaggcgtgcgctgctaatccttcctccttgttctgatcaaactgtgtgatcgatccatgtcgcatcggtcacctaaaatatggtgtgatggatcgatctatacggtcgtgattgctgtaaatactaatacatgctgcacagcaagtacgtgattgctgtaaatactatgtgctattatttgctatacaaagaaaatagctctctc

SEQ ID NO: 152 - protein, 474 aa, Triticum aestivum
  UNSURE (275)..(275): Xaa can be any naturally occurring amino acid
MARLSCSPLLLLLFLSSQLALLVAGEFLRLPSEKDVVGTRWAVLIAGSNGYYNYRHQADVCHAYQIMKKGGLKDENIIVFMYDDIAGNRDNPRPGVIINHPKGGDVYAGVPKDYTGADVNANNFLAALLGDKSKLTGSGSGKVVSSGPDDHIFVYYADHGGPGILGMPGDEEYLYANDLVRTLEKKHAGGAGYKSLVFYLEGLRVREHLRGPPPGQHQRVRHHGGQRGGEQLGHLLPRRRRGRPAAGVRHLPRRPLQRRLDGGQRRAQPQRRVPXAAVRAGQGPDVGGRHVQPRLPRHAVRRPGPQRPEPLRLHRHQPCQRQRLLRPGLLLDLQAAAGRRSEPAGRRPRPLLAQVPESAEGSAEKGEARRRLVETMARRSRVDSSVELIGGLLFGSEEGAKVLGAVRPAGQPVVDDWDCLKSVVRTFQQRCGPLTQYGMKHMRSLANLCNAGVREEAMDKAAAQACAANPSSLF

SEQ ID NO: 153 - DNA, 1723 bp, Triticum aestivum
ggcgcctactttaccccgcaccccgcgccgctcttctcgcccgtacgttccggctcccccgcgcggtgctcttagacagtagtgctactgcgacctcacctgcgcagacggatggcgccgcggtggtgcttcgcgttgctcctgctgctgtgtgcggcggccggggctgacgcctcgaaggggaagtgggacccggtgatccggatgccgggggaggaggagcccgccacgggcgacgagagctccgagaagggggaggacggcgtcgggacgaggtgggcggtgctcgtcgccggatcctccggctacggaaactacaggcaccaggccgatatatgccatgcctaccagatattgagaaaagggggcgtaaaagaggagaacatcgtggtttttatgtatgatgacattgccaacaaccctctcaacccgaggccaggggttatcatcaaccacccagagggcgaagatgtatatgctggcgttccaaaggactacaccggagaggcagttactgctaagaacttctatgcagttctcttgggcaacaaaactgcggtcactggagggagtaagaaggtcatagatagcaaaccaaatgaccatatatttatctactactcagatcacgggggtcccggagtccttggtatgcccaacctgccatatctctatgctgctgattttatcaaggtcttacaagaaaaacatgcatccaatacctatgcaaaaatggttatatatgtggaagcttgtgaaagtggcagtatttttgagggtttgatgcctgcagacctcaatatttatgtcacaacagcatctaatgcagaagaaagcagctggggtacatactgcccaggaatggaaccatcgcctccttctgagtatattacctgcttaggtgatctctacagtatttcttggatggaagacagtgagactaataatctgaaggaggagacaatcaagaagcagtatgaagtggtaaagaagcgaacctcagacatgaacagctatagtgccggttctcatgttatggagtatggcgacaagaccttcaaggatgagaagctttacctttatcaaggtttcaatcctgcaaacaccaacattacaaacaagctatttttgcaagcccaaaggctgcaatcaaccaaagagacgcagatcttcttttcttgtggaggaggtatgagctgctacatgaaaagtcgaaagagaagacgaacgttctgagggagatcagtgagacagtcacccacaggaagcatcttgacagcagcatcgattttattgggaagcttctatttggcttcgagaatggaccttcggtgcttcaagctgtcagaccttctgggaagcctctagtggacgactgggattgcctgaagaggatggtgcggatctttgagtctcattgcggatcgctcactcagtacggtatgaagcacatgcgagcatttgcaaatatatgcaacaatggtgtttctggcacgacgatgaaggaagcaagcatcaatacctgcggcggtcacaactcggcaagattgagcaccttgatccaagggtacagcgcttgatcgatcagtctgctgaggtacatactagtatgttccttgtcctcagcttacgcgaatgtgaatatgtagtattgtattgtattgtactgttagtgtatcctgaaaataaccttggggccggctatataagaatgtgcctatgt

SEQ ID NO: 154 - protein, 374 aa, Triticum aestivum
MAPRWCFALLLLLCAAAGADASKGKWDPVIRMPGEEEPATGDESSEKGEDGVGTRWAVLVAGSSGYGNYRHQADICHAYQILRKGGVKEENIVVFMYDDIANNPLNPRPGVIINHPEGEDVYAGVPKDYTGEAVTAKNFYAVLLGNKTAVTGGSKKVIDSKPNDHIFIYYSDHGGPGVLGMPNLPYLYAADFIKVLQEKHASNTYAKMVIYVEACESGSIFEGLMPADLNIYVTTASNAEESSWGTYCPGMEPSPPSEYITCLGDLYSISWMEDSETNNLKEETIKKQYEVVKKRTSDMNSYSAGSHVMEYGDKTFKDEKLYLYQGFNPANTNITNKLFLQAQRLQSTKETQIFFSCGGGMSCYMKSRKRRRTF

SEQ ID NO: 155 - DNA, 1847 bp, Triticum aestivum
acgcgtccgttaaacccctccttcctcctccccctcgcttcttcgcggaatccaaaccccaaacaccagccatggcgatggcgtccttccgcccccttcccctcgctctcctgctcgccgcgtgcctctcggcgctcgtgctggccgtggcgcacgcgcggaccctacggctggagcccaccatccggctgccgtcgcagcgcgccgccgggcaggaggacgatgactccgtcgggaccaggtgggccgtcctcatcgccggctccaacggctactacaactaccgccaccaggcggatatctgccacgcctaccagatcatgaagaagggtggtctcaaggatgagaacatcatcgtattcatgtacgacgacattgcgcacaacccggagaacccgaggccgggcgtcatcatcaaccacccccagggtggagatgtctatgctggggtccctaaggactacactggaaaggaggttaatgtcaagaacttctttgctgtcctgctcggtaataaaaccgctgtgagtggtgggagcggcaaagtcgtggacagtggccctaatgatcacatttttgtgttttacagtgaccatgggggtcctggggtccttgggatgcctacctatccatacctttacggtgacgatcttgtagatgtcctgaagaaaaagcacgctgctggaacctacaaaagcctggtattttaccttgaagcctgcgaatctgggagcatctttgagggacttctgccgaatgacatcggtgtctatgcgaccaccgcatcgaacgcagaggaaagcagttggggaacgtattgccccggcgagtaccccagccctccgccggaatatgacacttgcttgggcgacctgtacagcatttcttggatggaagacagtgatgtccacaacctgagaactgaatctctcaagcagcaatatgacttggtcaagaagagaacagcagctcaggactcatacagctatggttcccatgtgatgcaatacggttctttggacctgaatgctcaacaattctttttgtacatcggctcaaatcctgctaacaataacactacatttgttgaagataactcactgccgtccttctcaagagctgttaatcagagggatgctgatcttgtttacttctggcagaagtaccggaaattggctgagagctcccctgagaaaaacgatgctcggaagcaattgcttgaaatgatgggtcatagatctcatattgacaacagcgtcgagctgattggaaaccttctgtttggttctgcggatggtccgatggttctaaagactgttcgcccagctggtgagcctcttgttgatgactggagttgtctcaagtctacggtgcgtacttttgaatcacaatgtggctcgctggcgcagtatggaatgaagcacatgcggtcctttgcaaacatctgcaatgccggcattgttcctgaagcgatggcaaaggttgctgctcaggcgtgcacgagcatcccaaccaacccctggagtgccacacacaagggttttagtgcttaaaccagaggtgaagcaacttggtccctatctcagctattgtaccatataccaaagtcccttcctattcacacagggttagtagtgcttgaaccaacgaaccttagatgaataagaattatgccattatttcagctattccaccacaccaaattaccttggctgtgtccaacttataatgtacatatacccgtagtagaaaggtgatttcctgtgattgctgtacatactcgtgatagttcgtgatcagatgtgtagctctcaattccatatacgaatgcaatcactgctatttgt

SEQ ID NO: 156 - protein, 493 aa, Triticum aestivum
MAMASFRPLPLALLLAACLSALVLAVAHARTLRLEPTIRLPSQRAAGQEDDDSVGTRWAVLIAGSNGYYNYRHQADICHAYQIMKKGGLKDENIIVFMYDDIAHNPENPRPGVIINHPQGGDVYAGVPKDYTGKEVNVKNFFAVLLGNKTAVSGGSGKVVDSGPNDHIFVFYSDHGGPGVLGMPTYPYLYGDDLVDVLKKKHAAGTYKSLVFYLEACESGSIFEGLLPNDIGVYATTASNAEESSWGTYCPGEYPSPPPEYDTCLGDLYSISWMEDSDVHNLRTESLKQQYDLVKKRTAAQDSYSYGSHVMQYGSLDLNAQQFFLYIGSNPANNNTTFVEDNSLPSFSRAVNQRDADLVYFWQKYRKLAESSPEKNDARKQLLEMMGHRSHIDNSVELIGNLLFGSADGPMVLKTVRPAGEPLVDDWSCLKSTVRTFESQCGSLAQYGMKHMRSFANICNAGIVPEAMAKVAAQACTSIPTNPWSATHKGFSA

SEQ ID NO: 157 - DNA, 1790 bp, Triticum aestivum
ctacgaatatgaggcgctgcgcctgccgtccgcggagcagaactgccaggcgatcgacgatcacactttacctcctgcgcgcactgcacgccgacgcgagtataaaatgcgggcccagcccccgccggaacgatcacacttcactctctgccttctcttcctttctaggctctagcacacgcacatgatgaactcgagggtggcgatggctgcgtggtgggtttgtggactcctcccgctcctggcggaggcggccaaggggaactcggagccgctgatccggctgccgacggagaatgggcatgcccctgcccctgcgcctggccctgccgcgtcggcggcggaggaagaggtgacgaagtgggccgtgctcgttgccggctcctccggctacgagaactaccggcaccaggccgatgtgtgccacgcgtaccagatcctgaagaaggggggactcaaggatgagaacattgtggtgtttatgtacgatgacatcgccaacagccctgacaacccaaggcgtggagccgtcatcaaccatcctaaaggcaaagatgtttaccatggtgttcccaaggactacaccggtgaccaggtcactgctaagaacttgtatgcggttctcctggggaacaaaaccgcggttaccggagggagtaggaaggtgataaacagcaaaccgaaggatcacatcttcatctactacacggatcatgggggtcctggttcacttggtatgcccaacgggccatatgtttatgctggcgacttcatcaaagtgttacggcaaaagcatgcttccaaaagctattcgaaaatggtcatatatgttgaagcgtgtgaaagtggcagcatctttgagggtttgatgccacaagatcacaatatttatgttacagcggcatcaaatgcggtagaaagtagctgggcagcatactgccctgatgatggaacgccacctcctcctgaatattttacctgtttaggtgacttatacagtgtttcttggatggaagacagtgaaactcaaaatctaaagaacgaaaccatcaagcagcagtacgaggtggttaaagcgagaacggcaccccgaaatgagtccattagaggttctcatgtcatggagtatggcgacaagactttcaaggaggacatgcttttcctctaccaaggtttcgatccggcgaagtcaagcatcagaaacaggccgctgcctatgcccagcctcaagggtgcaatcaagcaaagagatgccgatattctcttcatgtggaagaagtatgggaagttgaatgggggatcagaagagaagcagagggccctcagggaggtcaaagaaaccgtgctgcacaggaagcatctggacagcagtatcgatttcatcgggaagcttgtctttgggttcgacaaggggcctttggtgctcgaggctgctagaggctctggccagccattggtcgacgattgggattgtctgaagacgatggtgcgagtgttcgagtcccagtgcggatcactcactcagtacggcatgaaacacacgagggcgttcgcaaacatgtgcaacaatggcgtctccgaggccgagatgaaggaggcgagcatcagcgcttgcgacggctacgacatggggaggtggagcccgttggttcgaggctacagcgcctgatccgcttgcagtgcagtactactacatggcagcagcagcagccagagctccggagttcctagctagacctcgtatggtgtacatacacacattggtataccgtatacatacaagaaagaag

SEQ ID NO: 158 - protein, 494 aa, Triticum aestivum
MMNSRVAMAAWWVCGLLPLLAEAAKGNSEPLIRLPTENGHAPAPAPGPAASAAEEEVTKWAVLVAGSSGYENYRHQADVCHAYQILKKGGLKDENIVVFMYDDIANSPDNPRRGAVINHPKGKDVYHGVPKDYTGDQVTAKNLYAVLLGNKTAVTGGSRKVINSKPKDHIFIYYTDHGGPGSLGMPNGPYVYAGDFIKVLRQKHASKSYSKMVIYVEACESGSIFEGLMPQDHNIYVTAASNAVESSWAAYCPDDGTPPPPEYFTCLGDLYSVSWMEDSETQNLKNETIKQQYEVVKARTAPRNESIRGSHVMEYGDKTFKEDMLFLYQGFDPAKSSIRNRPLPMPSLKGAIKQRDADILFMWKKYGKLNGGSEEKQRALREVKETVLHRKHLDSSIDFIGKLVFGFDKGPLVLEAARGSGQPLVDDWDCLKTMVRVFESQCGSLTQYGMKHTRAFANMCNNGVSEAEMKEASISACDGYDMGRWSPLVRGYSA

SEQ ID NO: 159 - DNA, 1897 bp, Hordeum vulgare
gaattaaaccccttcctcctcccaattcgcgtcttcacggaatccaaaccccaaacaccatccatggcgatggcgtccttccgcctccttcctctcgcgctcctgctctccgtggcgcacgcgcggaccccacggcttgagcccaccatccggctgccgtcgcagcgcgccgccgggcaggaggacgatgactccgtcgggaccaggtgggccgtcctcatcgccggctccaacggctactacaactaccgccaccaggccgatatctgccacgcctaccagatcatgaagaagggtggtctcaaggatgaaaacatcatcgttttcatgtacgacgacattgcgcgcaacccagagaacccaaggccgggcgtcatcatcaaccacccccagggtggagatgtctatgctggggtccctaaggactacactgggaaggaggttaatgtcaagaacttctttgctgtcctgctcggtaataaaactgctgtgaatggtgggagcggcaaagtcgtggacagtggccctaatgatcacatttttgtgttttacagtgaccatgggggtcctggggtccttgggatgcctacctacccatacctttatggtgacgatcttgtagatgtcctgaagaaaaagcatgctgctggaacctacaaaagcctggtcttttaccttgaagcctgtgaatctgggagcatctttgaggggcttctgccgaatgatatcggtgtctacgcgaccaccgcatcaaacgcagaggagagcagttggggagcgtattgccctggcgagtacccgagccctccgccggaatatgacacttgcttgggcgacctatacagcatttcttggatggaagacagtgatgtccacaacctgaggactgaatctctcaagcagcagtataacctggtcaagaagagaacggcagctcaggactcatacagctatggttcccatgtgatgcaatacggttctttggacctcaatgctgaacatttgttctcgtacattgggtcaaatcctgctaacgagaacactacatttgttgaagataatgcattgccgtcgttatcaagagctgttaatcagagggatgctgatcttgtttatttctggcagaagtaccggaaattggctgagagctcccctgcgaaaaacaatgctcgtaagcaattgctcgaaatgatgggtcatagatctcatattgacagcagcgttgagctgattggaaaccttctgtttggttctgcgggtggtccaatggttctaaagactgttcgcccagctggtgagcctcttgtggatgactggagttgtctcaagtctacggtgcgtacttttgaatcccaatgtggctcgttggcgcagtatggaatgaagcacatgcggtcctttgcaaacatgtgtaatgccggcattgttcctgaagcgatggcaaaggttgctgctcaggcgtgcacgagcttcccaaccaacccgtggagtgccacacacaagggttttagtgcttaaaccagaggtgaagaagcaacgtaatcactatctcagctattgtaccatataccaaagtcccttcctattcacacagggttagtagtgcttgaacgagccttaggtgaataagaattatgctattatttcggctattccatcatactccctctgttcctaaatacttgttgttggggagaactctccccggcaacaaatattatggtacagagggagtagtaccaaattatacacttataatgtacatataccgtggtagaaaggtggtttcctgtgattgctgtacagactcatgatagtttgtgatgaaatgtgtagctcgcaattccatatatgaagaatgaatgcattcgctgctaaaaaaaaaaaaaaaaaaaaa

SEQ ID NO: 160 - protein, 484 aa, Hordeum vulgare
MAMASFRLLPLALLLSVAHARTPRLEPTIRLPSQRAAGQEDDDSVGTRWAVLIAGSNGYYNYRHQADICHAYQIMKKGGLKDENIIVFMYDDIARNPENPRPGVIINHPQGGDVYAGVPKDYTGKEVNVKNFFAVLLGNKTAVNGGSGKVVDSGPNDHIFVFYSDHGGPGVLGMPTYPYLYGDDLVDVLKKKHAAGTYKSLVFYLEACESGSIFEGLLPNDIGVYATTASNAEESSWGAYCPGEYPSPPPEYDTCLGDLYSISWMEDSDVHNLRTESLKQQYNLVKKRTAAQDSYSYGSHVMQYGSLDLNAEHLFSYIGSNPANENTTFVEDNALPSLSRAVNQRDADLVYFWQKYRKLAESSPAKNNARKQLLEMMGHRSHIDSSVELIGNLLFGSAGGPMVLKTVRPAGEPLVDDWSCLKSTVRTFESQCGSLAQYGMKHMRSFANMCNAGIVPEAMAKVAAQACTSFPTNPWSATHKGFSA

SEQ ID NO: 161 - DNA, 1853 bp, Glycine max
gggtaggagatactctcattcacctcccatcatcattataatcattcattccaacctacccttattcttcttcttcaatttcacacccatcatggaccgttttccgatcctctttctcgtcgccaccctcatcaccctcgcctccggtgcccgccacgatattctccggttaccctccgaagcttccaggttcttcaaagcacctgctaatgccgatcaaaacgatgagggcaccaggtgggccgttttagttgccggttccaatggctactggaattacaggcaccagtctgatgtttgccatgcatatcaactactgaggaaaggtggtgtgaaagaggaaaatattgttgtatttatgtatgatgacattgctttcaatgaagagaacccgcgacctggagtcattattaacagtccacatggaaatgatgtttacaagggagttcctaaggattacgttggtgaagatgttactgttgacaacttttttgctgctatacttggaaataagtcagctcttactggtggcagtgggaaggttgtggatagtggccccaatgatcatatatttatatactactctgatcatggcggtccgggagtgctagggatgcctactaatccatacatgtatgcatccgatctgattgaagtcttgaagaagaagcatgcttctggaacttataaaagcctagtattttatctagaggcatgtgaatctgggagtatctttgaaggtcttcttccagaaggtctgaatatctatgcaacaacagcttcaaatgcagaagaaagcagttggggaacatattgtcctggggagtatcctagtcctccctctgaatatgaaacctgcctgggtgacctgtacagtgttgcttggatggaagacagtgacatacacaatttgcaaacagaaactttacatcaacaatacgaattggtcaaacaaaggactatgaatggaaattcaatttatggttcccacgtgatgcagtatggtgacatagggcttagcgagaacaatctcgtcttatatttgggtacaaatcctgctaatgataattttacttttgtgcttaaaaactcattggtgccaccttcaaaagcagtcaaccaacgtgatgcagatctcatccatttttgggataagttccgcaaagctcctgtgggttcttctaggaaagctgcagctgagaaacaaattcttgaagcaatgtctcacagaatgcatatagatgacagcatgaaacttattggaaagctcttctttggcattgaaaagggtccagaactgcttagcagtgttagacctgctgggcaaccacttgttgatgactgggactgccttaaaacactggttaggacttttgagacacattgtggatctctgtctcagtatgggatgaaacatatgaggtcctttgcaaacttctgcaacgctggaatacggaaagagcaaatggctgaggcctcggcacaagcatgtgtcagtatccctgcaagttcctggagttctctgcacaggggtttcagtgcataattcctagaatccgctccattgaagacagagtatagtcgttgtaacattattctttacgagcgttatggactgtacctggacatgatttcttataccaaccctgtaaataagcatgggacgctggggaaacctctttacattatagtttcctgcaaaatagatgctgtaacaaagacattttacttttacttggggagaggcagtggaaccataaggacccttggaacttctaattaatacgacagggcacaataccgtgtttgtaagccaacgctttgtttcaatttaatggtaaccccgttgtgta

SEQ ID NO: 162 - protein, 484 aa, Glycine max
MDRFPILFLVATLITLASGARHDILRLPSEASRFFKAPANADQNDEGTRWAVLVAGSNGYWNYRHQSDVCHAYQLLRKGGVKEENIVVFMYDDIAFNEENPRPGVIINSPHGNDVYKGVPKDYVGEDVTVDNFFAAILGNKSALTGGSGKVVDSGPNDHIFIYYSDHGGPGVLGMPTNPYMYASDLIEVLKKKHASGTYKSLVFYLEACESGSIFEGLLPEGLNIYATTASNAEESSWGTYCPGEYPSPPSEYETCLGDLYSVAWMEDSDIHNLQTETLHQQYELVKQRTMNGNSIYGSHVMQYGDIGLSENNLVLYLGTNPANDNFTFVLKNSLVPPSKAVNQRDADLIHFWDKFRKAPVGSSRKAAAEKQILEAMSHRMHIDDSMKLIGKLFFGIEKGPELLSSVRPAGQPLVDDWDCLKTLVRTFETHCGSLSQYGMKHMRSFANFCNAGIRKEQMAEASAQACVSIPASSWSSLHRGFSA

SEQ ID NO: 163 - DNA, 2066 bp, Glycine max
gagagcaatgcttttcccggaaaaggagagagacataaaaaaagttccaagaaagaatcacagaattttcgcagaagcaggccaagaatacacgcatcccaaaccgttattaacgtgtcagcctctaaatttgcatggcatattgtctttaactgagtcaattccttaataaaccctctgctttaccaaccctgttctcactcattcacatactataatactacgatagcgtagactcttcccagttctgttgtgtgagtctgtgagtctttcttagctgatatggcggttgatcgctcccttacgaggtgctgtagcctcgtactgtggtcgtggatgttgctgaggatgatgatggcgcagggtgcagccgcgagggccaaccggaaggagtgggactcggtcataaagttaccggctgaaccggtcgatgctgactcggatcatgaagtgggaacacgatgggcggttcttgtggctggttcaaacggctatggaaactacaggcatcaagcagatgtgtgccatgcgtaccagttgctgataaaaggtgggctaaaagaagagaacatagtggtgtttatgtacgatgacatagctacagacgagttaaatcccagacctggagtcatcatcaaccaccctgagggacaagatgtgtatgctggtgttcctaaggattacaccggtgataatgtgacgacggagaacctctttgctgttattcttggagacaagagtaaattgaagggaggaagtggcaaagtgatcaacagcaaacccgaggacagaatatttatatactactctgatcatggaggtcctggaatacttgggatgccaaacatgccatacctttatgccatggattttattgatgtcttgaagaagaaacatgcatctggaagttacaaggagatggttatatacgtggaagcttgtgaaagtgggagcgtgtttgagggtataatgcctaaggatctgcagatttatgtcacaactgcatccaatgcacaagagaatagttggggaacttattgtcctggaatggatccttctccacctccagagtacatcacttgcctaggggatttgtacagtgttgcttggatggaagatagtgagactcataatctaaaaagggagtccgtgaaacaacaatacaaatcggtaaagcaacggacttcaaatttcaacaactatgcgatgggttctcatgtgatgcaatacggtgacacaaacatcacagctgaaaagctttatttataccaaggttttgatcctgccgctgtgaacttccctccacaaaacggaaggctagaaactaaaatggaagttgttaaccaaagagatgcagaacttttcttcatgtggcaaatgtatcagagatcaaaccatcagccagaaaagaagacagacatcctcaaacagatagcggagacagtgaagcataggaaacacatagatggtagcgtggaattgattggagttttattgtatggaccaggaaaaggttcttctgttctacaatccatgagggctcctggtcttgcccttgttgatgactggacatgcctaaaatcaatggttcgggtgtttgagactcactgtgggacactgactcagtatggcatgaaacacatgcgagcatttgccaacatttgcaacagtggcgtttctgaggcctccatggaagaggcttgtttggcagcctgtgaaggctacaatgctgggctattgcatccatcaaacagaggctacagtgcttgattttgggttttgtacacaaaagctttaaagcccggttgatgatgtaatatttctctattgcattctgcctactggtttctgctgcttgtgtcaaattttctctaaactagagtagcccaatagcatacgtgttatgtgcattggtcatgtatacaagtgtaatactaaaaccttctacataatataagattagttagtttggtttaaaaaaaaaaaagggtctgttgcaagctctattttcttgacggcaactccttctaagtcaaggagatttttccaaaaaaaaaaaaaaaaaa

SEQ ID NO: 164 - protein, 495 aa, Glycine max
MAVDRSLTRCCSLVLWSWMLLRMMMAQGAAARANRKEWDSVIKLPAEPVDADSDHEVGTRWAVLVAGSNGYGNYRHQADVCHAYQLLIKGGLKEENIVVFMYDDIATDELNPRPGVIINHPEGQDVYAGVPKDYTGDNVTTENLFAVILGDKSKLKGGSGKVINSKPEDRIFIYYSDHGGPGILGMPNMPYLYAMDFIDVLKKKHASGSYKEMVIYVEACESGSVFEGIMPKDLQIYVTTASNAQENSWGTYCPGMDPSPPPEYITCLGDLYSVAWMEDSETHNLKRESVKQQYKSVKQRTSNFNNYAMGSHVMQYGDTNITAEKLYLYQGFDPAAVNFPPQNGRLETKMEVVNQRDAELFFMWQMYQRSNHQPEKKTDILKQIAETVKHRKHIDGSVELIGVLLYGPGKGSSVLQSMRAPGLALVDDWTCLKSMVRVFETHCGTLTQYGMKHMRAFANICNSGVSEASMEEACLAACEGYNAGLLHPSNRGYSA

SEQ ID NO: 165 - DNA, 3065 bp, Glycine max
aaaatgcccactttttttcttccaacgctcctcctccttctcatagccttcgccacctctgtctccggccgccgtgacctcgtcggagactttctccggctgccctccgaaactgataacgacgacaacttcaagggcacccggtgggccgtcctcctcgccggttccaatggttactggaattacagacatcaggctgatgtttgtcacgcctatcaaatattgaggaaaggtggtctgaaagaagaaaatattattgtttttatgtatgatgacattgcattcaatggggaaaacccaaggcctggagtcatcattaacaaaccagatggaggtgatgtttataaaggagttccaaaggattacaccggcgaagatgttactgttgataacttttttgctgctttacttggaaataagtcagcactgactggtggcagtgggaaggttgtggacagtggtcctgatgatcatatatttgtatactatactgaccatggaggtcctggggtgctcgggatgcctgctggtccttacttatacgcggatgatctgattgaagtcttgaagaaaaagcatgcttctggaacatataaaaacctagtattttatctggaggcatgtgaatctgggagtatctttgaaggtcttcttcctgaagatatcaatatttatgcaaccactgcttccaatgcagaagaaagtagttggggaacatattgccccggggagtatcctagtcctcccccagaatatacaacctgtttgggtgacttgtacagtgttgcttggatggaagacagtgacagacacaatttgcgaacagaaactctgcaccaacaatataaattggttaaagagaggactatatctggagattcatactatggctctcacgtgatgcagtatggtgatgtacggcttagcagtgatgttctcttccattatttgggtacagatcctgctaatgataatttcacttttgtggatgaaaactccttatggtcaccttcaaaaccagtcaaccaacgtgatgctgatctcatccatttttgggataagttccgcaaagctcctgagggttctctcaggaaaaatacagctcagaaacaagttttggaagcaatgtctcacagaatgcatgtagacaacagtgtaaaactgattgggaagcttttatttggcattgaaaagggtccagaagtactcaacgctgttagaccggctggatcggcacttgttgatgactggcactgcctgaaaaccatggtgaggacttttgagacacattgtggatccttgtctcaatatggcatgaaacacatgaggtcctttgcaaacatctgcaatgtagggataaagaatgagcaaatggctgaggcctctgcacaagcttgtgtctctattccttccaatccttggagttctctgcaaaggggtttcagtgcataataattcctgtaatgtgcaccagtaaagaccaaagtatgattattgttacattatgctatatgattgtacttgtatatacatattttgtcccgcctttgtaaatacaattgggacactactaggattgggaagaagggtctttacatttttagtttggcaaatagatattgcaactacctttgtataaatctatttctgaagaagcaattacaactttcaagggatgatagcattttgtggcataaggattaaggaggcataaaggaccaattgctttggaatattcactcatgacaaggcacaaggtcatgcgtgtatgccaacacatagtaatgatgtgtgtttttattcagtaggcaactggcagatcgggttttcccttgtcacttttgtataattattttggaagaatttatgatgtcaaagttattgtttaatattaatggcgacattgtatttattatttgtaaaataagaaaaaaaggtgaaatatagagtgaagaagaagaaatagagggttttggtgtttgaatcgtgaaaatgttcagaaaccagtacgacacggacgtgacgacatggagcccggcggggaggctgttccaggtggagtacgcgatggaggcggtgaagcagggctcggcggcgatagggctccgatccaagacccacgtggtcctcgcatgcgtcaacaaggctaactccgaactctcatcgcaccagaagaagatcttcaaggtcgacaaccacatcggcgtcgccatcgccggcctcaccgccgacggccgcgtcctctcccgctacatgcgatccgagtgcatcaactataactacacctacgagtcaccgctccccgtagggagactcgtcgttcagctcgccgataaggctcaggtttgcacccagcggtcatggaaacgtccttatggagttggactcctggtagctggattagatgaatcaggagctcacctctattacaactgtcccagtggaaactattttgaatatcaggcttttgctattgggtctcgctctcaagctgcaaagacatatttggaacgcaggtttgagaattttgtgggctcttcacgagaagatctgatcaaagatgcacttattgcaactagggagtccttgcaaggtgaaaaactcaggagttctgtgtgcacaattgctgtggttggtgttggtgagccattccacattttggatcaggaaactgttcaacagttgattgatacttttgagattgtgagggaggaagaagctgctccagctgaagaagaagctcagccagcagccgaacaggatgctcccacagatccaggtgctgctgctgcagatcaaggtggtggttgctgctgctgtagaccaaggtggttctcctatggacatttgataatttaaaattaagtactagaggtgttgaataccaatatttaaagacgagtaggtttcatgtgtcatgggacaagatatttctttgatggaatttttttccccttaatcctgtttgttttttcaattcatccatgcctgatcattgtaaacgattttatagctgtttgatgaacttgaatgcatgatttacaataattaattgaaattcaggc

SEQ ID NO: 166 - protein, 482 aa, Glycine max
MPTFFLPTLLLLLIAFATSVSGRRDLVGDFLRLPSETDNDDNFKGTRWAVLLAGSNGYWNYRHQADVCHAYQILRKGGLKEENIIVFMYDDIAFNGENPRPGVIINKPDGGDVYKGVPKDYTGEDVTVDNFFAALLGNKSALTGGSGKVVDSGPDDHIFVYYTDHGGPGVLGMPAGPYLYADDLIEVLKKKHASGTYKNLVFYLEACESGSIFEGLLPEDINIYATTASNAEESSWGTYCPGEYPSPPPEYTTCLGDLYSVAWMEDSDRHNLRTETLHQQYKLVKERTISGDSYYGSHVMQYGDVRLSSDVLFHYLGTDPANDNFTFVDENSLWSPSKPVNQRDADLIHFWDKFRKAPEGSLRKNTAQKQVLEAMSHRMHVDNSVKLIGKLLFGIEKGPEVLNAVRPAGSALVDDWHCLKTMVRTFETHCGSLSQYGMKHMRSFANICNVGIKNEQMAEASAQACVSIPSNPWSSLQRGFSA

SEQ ID NO: 167 - DNA, 1756 bp, Brassica napa
tcatcaccttattgattggttgacaaaaaacaaacagataagaaaagaaaagattcattatttaatagttcccccgccgattaaaagattcgtatccacgtcaccatacgcctctccaacgatgacacctgtcgccgtcgccgttctcgtcctctccttgatcgccgtctccgccgcaagacaaaaccccgacgacgacgtcatcaaactcccctcgcaagcttccaggttcttccgccccaacaacgacgacgaatcttcatcgtccggcaccaggtgggccgttctggtcgccggatcgagcggttattggaactacagacatcaggctgatgtttgtcatgcttatcaactactgaggaaaggaggattgaaagaggagaatattgtggttttcatgtatgatgatattgctgataatgaagagaatccgaggaaagggatcattatcaatagccctcatgggagtgatgtctatgaaggagttcccaaggattacactggagatgatgttactgttgataatctgtttgctgtgatccttggagataaaactgctgttaagggagggagtgggaaggttgtggatagtggtcctaatgatcatatttttatattctatagtgaccatggtggtcctggagttcttgggatgccgacttctccttacttatatgctgatgacttgaatgatgtcttgaagaaaaaacatgcttccggaacctacaaaagcatggtgttctatcttgaagcttgtgagtctggaagtatctttgaagggcttcttgaagagggtttaaacatctacgccacaactgcatcaaacgcagtggaaagcagttggggtacctattgccctggggaggagcctagccctccaccggagtatgaaacttgcttaggtgacttatacagtgttgcatggatggaagacagcggtgtgcacaatctacaaactgagactctacgccaacaatatgagctagtgaagaggaggactgctggtggtgcgtcggcttacggttctcatgtgatgcaatatggagatgtaggacttaacaaggataagctcgacctttacatgggaacaaaccctgccaatgacaacttcacttttgtggatgctaattcactgactccaccttcaggagttactaaccagcgtgatgcagatcttgtccatttctgggataagtaccgaaaggcaccagaaggttccacaaggaaaacagaagctcagaagcaagtccttgaagccatgtctcacagacttcatgttgacaacagtgtgaaactcgtcggcaaactcttgtttggtatctcagaaggttctgaagtgctaaacaaagtaaggcctgctggacaacctctggccgatgactggacttgccttaaaaacacggtgagagcttttgagagacactgtgggtcgctgtcacagtacggtatcaagcacatgaggtcatttgcaaacatctgcaacgcagggatccaaatggagcaaatggaagaggcagcttcacaggcttgcacctcaatcccatctggtccttggagctctcttcaccgtggattcagtgcttaaaacccctaaatccctctttgcatttgtttaatactagtaccaatacccaaatattcctatttcgattcccctgtatatctcattatcatttccctcttgattatctaattacagattatacatatgctttgtacaaaatgcttgtagaaactcaagttaatgtaaacaacg

SEQ ID NO: 168 - protein, 487 aa, Brassica napa
MTPVAVAVLVLSLIAVSAARQNPDDDVIKLPSQASRFFRPNNDDESSSSGTRWAVLVAGSSGYWNYRHQADVCHAYQLLRKGGLKEENIVVFMYDDIADNEENPRKGIIINSPHGSDVYEGVPKDYTGDDVTVDNLFAVILGDKTAVKGGSGKVVDSGPNDHIFIFYSDHGGPGVLGMPTSPYLYADDLNDVLKKKHASGTYKSMVFYLEACESGSIFEGLLEEGLNIYATTASNAVESSWGTYCPGEEPSPPPEYETCLGDLYSVAWMEDSGVHNLQTETLRQQYELVKRRTAGGASAYGSHVMQYGDVGLNKDKLDLYMGTNPANDNFTFVDANSLTPPSGVTNQRDADLVHFWDKYRKAPEGSTRKTEAQKQVLEAMSHRLHVDNSVKLVGKLLFGISEGSEVLNKVRPAGQPLADDWTCLKNTVRAFERHCGSLSQYGIKHMRSFANICNAGIQMEQMEEAASQACTSIPSGPWSSLHRGFSA

SEQ ID NO: 169 - DNA, 1604 bp, Brassica napa
tttacacagagagagcaaaacaacagttctttagagtaattttctgacaatgtcttctcttggtcatttacttgttcttgtgtttctctatgttctgcttttttactcagctgattctcgcaaaccccaagtccttcatgacactggatctagcgaagatggtgcaaaaggcacaagatgggctgttctaattgctggatcaagttattattataactacaggcatcaggctgacatatgccatgcatatcaagttctgcgaaaagggggtctaaaagatgaaaacattattgtgtttatgtatgatgatatcgcgtttaaccctgagaatcccaggcctggagttatcatcaatagacctgatggtggagatgtttatgaaggcgttcctaaggactacactaaagaggctgttaatgtgaagaacttttataatgtgatacttggaaacgaaagtggcatcacaggaggaagtggcaaagttgtgaaaagtggtcctaatgatagtatattcatctactatgctgaccatggagctcctggtttactatcgatgcctgatggtgaagatatccatgcaaaagatttcattaaagtcttggagaagatgcataagcttaaaagatacaagaagatggtgatttatgttgaagcatgtgagtctggaagtatgtttgaagggattttaaagaccaatctaaacatacttgcagtaactgcttctaatgcgacagagagcagttttggaatctactgtcctggtgaatatcctcctcctcctcctgaatataatggtgtttgtctcggcgatacatttagcgtctcttggcttgaggacagtgagcttcatgacatgagtaaagagacattgaagcagcaataccaagctgtaaagagaagaacaggtcctgatgctgaaccagggacgagttctcatgtaagccgtttcggatcaaaggcgcttcttaaagactatcttgtctcttacattggaaccaatcctgataacgaaaacttcacttttgctggattcactgcttcaccaatctctacttcaagctcggtcaatactcgcgatatccctttgttatatctcaagagcaagattcaaagatctccaatggagtcacctgaaagacaagagcttcagaagaagctgtttgaagaaatgaatcataggagacaaatcgatcagaacattgtggagattcttaaactttcacttaagcaaaccaatgtcttaaatctcttaatttccacaagaacaacaggacaacctcttgtagacgactgggattgcttcaagactctggttaatagcttcaagaatcactgtggagcaacgatggattacggattgaagtatacaggagcgcttgccaatatctgcaatatgggagtggatgtgaagcaaactgtttcagctattgaacacgcttgtgcacattaaatgaaatgatgtgcataaataatgtgatcgacttaaaaaatatgaaagttattgcattaagatatatgaactgtcgagatggttgatgatgcctatttttactttaataaaaaatttagttggtaacgcgaaaaaaaaaaaaaaaaccgcccct

SEQ ID NO: 170 - protein, 466 aa, Brassica napa
MSSLGHLLVLVFLYVLLFYSADSRKPQVLHDTGSSEDGAKGTRWAVLIAGSSYYYNYRHQADICHAYQVLRKGGLKDENIIVFMYDDIAFNPENPRPGVIINRPDGGDVYEGVPKDYTKEAVNVKNFYNVILGNESGITGGSGKVVKSGPNDSIFIYYADHGAPGLLSMPDGEDIHAKDFIKVLEKMHKLKRYKKMVIYVEACESGSMFEGILKTNLNILAVTASNATESSFGIYCPGEYPPPPPEYNGVCLGDTFSVSWLEDSELHDMSKETLKQQYQAVKRRTGPDAEPGTSSHVSRFGSKALLKDYLVSYIGTNPDNENFTFAGFTASPISTSSSVNTRDIPLLYLKSKIQRSPMESPERQELQKKLFEEMNHRRQIDQNIVEILKLSLKQTNVLNLLISTRTTGQPLVDDWDCFKTLVNSFKNHCGATMDYGLKYTGALANICNMGVDVKQTVSAIEHACAH

SEQ ID NO: 171 - DNA, 1943 bp, Zea mays
tccactctcgctccctctccctcccttccctcccacgcaaatggtggccgctcgcctccgcctctcgctgctactctccgtctgcctctcctccgcgtgggcgcgcccacgcctcgagccggccatccgcctgccgtcgcagcgcgccgcggcggccgacgaaacggacgacggcgacgtcgggacccgctgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagaggtcaacgtcgacaatttcttcgctgttctgcttggcaacaaaactgctctcaggggtgggagcggcaaggttgtggacagtggccccaatgatcatatatttgttttctacagtgaccatgggggtcctggtgtccttggaatgcctacgtatccatatctctatggtgatgacctcgtagatgtcctgaagaagaagcatgctgccgggacctacaaaagcctggtcttttaccttgaagcgtgcgaatctgggagcatctttgagggcctcctgccgaatgacatcaatgtgtatgcgaccaccgcgtcaaatgcagaggagagtagctgggggacgtactgccctggcgagttcccgagccctccaccggagtatgacacttgcttgggagacctgtatagtgttgcttggatggaagacagtgatttccacaatctgcgaactgaatctctcaagcagcaatacaacttggtcaaggataggacagcggttcaggatacattcagctatggctcccatgtgatgcaatatggttcattggagttgaatgttaagcatctgttttcgtacattggcacaaaccctgctaacgatgacaacacgtttatagaagacaactcgttgccatcattctcaaaggctgttaatcagcgcgacgctgaccttgtctacttctggcagaagtaccggaaattggcagacagctcacctgagaaaaatgaagctcggagggagttgcttgaagtgatggcccacaggtctcatgttgacagcagtgttgagctcattggaagccttctctttggctctgaggacggtccaagggttctgaaagccgtccgtgcagctggtgagcctctggtcgatgattggagctgtctcaagtccacggttcgtacttttgaggcgcaatgtgggtcgttggcgcagtatgggatgaagcacatgcggtccttcgcaaacatctgcaacgctggcatccttcctgaggcagtgtcgaaggtcgctgctcaggcttgcaccagcattccttccaacccctggagttctatccacaagggttttagcgcctaagaatcataaggtgaggcgaaatatttcagccgctccaccgcaacgaactggtttacattaccagtcctcaggggggtcctagttcttgaaccataggtgaagcagacttataccactattatagctgttccaccgtcgttccagattacatagctatgcccaatttccggtgtacatatatagtcggaaagttatttggcaattgtattggtcgttgctgtatatattccctatagtttgttagcagatgtgtagtttgtaattccataaaaatgaaggacgcgttactgctatttctatgtagccgactggtgctcatgtgaaactttaccccattcttgttgggaaatgtactatccgtggtggaattcttgcatcgaaaacaattcccgggtggtcctttattcaaaaaaaaaaaaaaaaaagcggccggtgctagagg

SEQ ID NO: 172 - protein, 486 aa, Zea mays
MVAARLRLSLLLSVCLSSAWARPRLEPAIRLPSQRAAAADETDDGDVGTRWAVLIAGSNGYYNYRHQADICHAYQIMKKGGLKDENIVVFMYDDIAHSPENPRPGVIINHPQGGDVYAGVPKDYTGREVNVDNFFAVLLGNKTALRGGSGKVVDSGPNDHIFVFYSDHGGPGVLGMPTYPYLYGDDLVDVLKKKHAAGTYKSLVFYLEACESGSIFEGLLPNDINVYATTASNAEESSWGTYCPGEFPSPPPEYDTCLGDLYSVAWMEDSDFHNLRTESLKQQYNLVKDRTAVQDTFSYGSHVMQYGSLELNVKHLFSYIGTNPANDDNTFIEDNSLPSFSKAVNQRDADLVYFWQKYRKLADSSPEKNEARRELLEVMAHRSHVDSSVELIGSLLFGSEDGPRVLKAVRAAGEPLVDDWSCLKSTVRTFEAQCGSLAQYGMKHMRSFANICNAGILPEAVSKVAAQACTSIPSNPWSSIHKGFSA

SEQ ID NO: 173 - DNA, 1437 bp, Arabidopsis thaliana
atgaccaccgtcgtttcctttctcgccctcttcctctttctagtcgccgccgtttctggtgacgtcatcaaacttccttctctagcttctaagttcttccgcccaactgaaaacgacgatgattctactaagtgggctgttctcgtcgccggatccagcggatactggaattatcgtcatcaggcggatgtttgtcatgcttatcagcttttgaagaaaggtggagtgaaagaggagaatattgtggtgtttatgtatgatgacattgcgaagaacgaggagaatccaagacctggagttattatcaatagtcctaatggagaggatgtctataatggagttcccaaggattacactggagatgaagttaatgttgataacttattagctgtgattcttggaaacaaaacggctcttaaaggaggaagtgggaaagttgtagatagcggtccaaacgatcatatctttatatactatagtgatcacggtggtccgggagtgctcgggatgccaacttctccaaacctatatgcaaatgatctcaatgatgtcttgaagaaaaaatatgcttcaggaacatataagagcttggtgttttatttggaggcttgtgaatctggaagtatttttgaaggtcttttaccagagggtttaaatatttacgcgacaactgcatcgaatgcagaagaaagtagctggggtacttactgtcctggagaggatcctagtcctccttctgagtatgagacctgtttgggtgacttatacagtgttgcttggatagaagatagtgaaaaacacaatttacaaacagagactttgcacgagcaatatgaattggtgaaaaagagaactgcaggttctggtaagtcttatggttctcatgttatggaatttggagatataggactcagcaaggagaagcttgtcctttttatgggtacaaatccagcagatgaaaacttcacctttgtgaatgagaattcaataaggccgccttcaagagttacaaaccagcgtgatgcggatcttgtccatttctggcataagtatcaaaaggcaccggaagggtcagcaagaaaagttgaagctcagaagcaagtccttgaagcaatgtctcacagacttcatgttgataatagcattctgttgattgggattcttttgtttggtttggaaggtcatgcggtgttaaataaagtccggccttctggagaaccgcttgttgacgattgggactgccttaaatctctggtgagagctttcgagaggcactgtggatcgttgtctcagtacggaataaagcacatgaggtcgattgcaaacatgtgcaacgcagggattcagatgaggcaaatggaggaggcagcaatgcaggcttgtcccaccatccctaccagtccttggagctctcttgaccgtggattcagtgcttga

SEQ ID NO: 174 - protein, 478 aa, Arabidopsis thaliana
MTTVVSFLALFLFLVAAVSGDVIKLPSLASKFFRPTENDDDSTKWAVLVAGSSGYWNYRHQADVCHAYQLLKKGGVKEENIVVFMYDDIAKNEENPRPGVIINSPNGEDVYNGVPKDYTGDEVNVDNLLAVILGNKTALKGGSGKVVDSGPNDHIFIYYSDHGGPGVLGMPTSPNLYANDLNDVLKKKYASGTYKSLVFYLEACESGSIFEGLLPEGLNIYATTASNAEESSWGTYCPGEDPSPPSEYETCLGDLYSVAWIEDSEKHNLQTETLHEQYELVKKRTAGSGKSYGSHVMEFGDIGLSKEKLVLFMGTNPADENFTFVNENSIRPPSRVTNQRDADLVHFWHKYQKAPEGSARKVEAQKQVLEAMSHRLHVDNSILLIGILLFGLEGHAVLNKVRPSGEPLVDDWDCLKSLVRAFERHCGSLSQYGIKHMRSIANMCNAGIQMRQMEEAAMQACPTIPTSPWSSLDRGFSA

SEQ ID NO: 175 - DNA, 1461 bp, Arabidopsis thaliana
atggctaagtcttgctatttcagaccagctcttcttcttctgttagttcttttggttcatgccgagtcacgcggtcggttcgagccaaagattcttatgccgacagaggaagctaacccggctgaccaagacgaagatggtgtcggtacaagatgggcggttctcgtcgctggttcttctggatatggaaactacagacaccaggctgacgtgtgtcacgcatatcaaatactaagaaaaggaggtttaaaggaagaaaacatagtcgttttgatgtatgatgatatcgcaaaccacccacttaatcctcgtccgggtactctcatcaaccatcctgacggtgacgatgtttacgccggagtccctaaggactatactggtagtagcgttacggctgcaaacttctacgctgtactcctaggcgaccagaaggctgttaaaggtggaagcggtaaggtcatcgctagcaagcccaacgatcacattttcgtatattatgcggatcatggtggtcccggagttcttgggatgccaaatacgcctcacatatatgcagctgattttattgaaacgcttaagaagaagcatgcttccggaacatacaaagagatggttatatacgtagaagcgtgtgaaagtgggagtattttcgaagggataatgccaaaggacttgaacatttacgtaacaacggcttcaaatgcacaagagagtagttatggaacatattgtcctggcatgaatccgtcacccccatctgaatatatcacttgcttaggggatttatatagtgttgcttggatggaagatagtgagactcacaatttaaagaaagagaccataaagcaacaataccacacggtgaagatgaggacatcaaactacaatacctactcaggtggctctcatgtgatggaatacggtaacaatagtattaagtcggagaagctttatctttaccaagggtttgatccagccaccgttaatctcccactaaacgaattaccggtcaagtcaaaaataggagtcgttaaccaacgcgacgcggaccttctcttcctttggcatatgtatcggacatcggaagatgggtcaaggaagaaggatgacacattgaaggaattaactgagacaacaaggcataggaaacatttagatgcaagcgtcgaattgatagccacaattttgtttggtccgacgatgaatgttcttaacttggttagagaacccggtttgcctttggttgacgattgggaatgtcttaaatcgatggtacgtgtatttgaagagcattgtggatcactaacgcaatatgggatgaaacatatgcgagcgtttgcaaacgtttgtaacaacggtgtgtccaaagagctgatggaggaagcttctactgcggcatgcggtggttatagtgaggctcgctacacggtgcatccatcaatcttaggctatagcgcctga

SEQ ID NO: 176 - protein, 486 aa, Arabidopsis thaliana
MAKSCYFRPALLLLLVLLVHAESRGRFEPKILMPTEEANPADQDEDGVGTRWAVLVAGSSGYGNYRHQADVCHAYQILRKGGLKEENIVVLMYDDIANHPLNPRPGTLINHPDGDDVYAGVPKDYTGSSVTAANFYAVLLGDQKAVKGGSGKVIASKPNDHIFVYYADHGGPGVLGMPNTPHIYAADFIETLKKKHASGTYKEMVIYVEACESGSIFEGIMPKDLNIYVTTASNAQESSYGTYCPGMNPSPPSEYITCLGDLYSVAWMEDSETHNLKKETIKQQYHTVKMRTSNYNTYSGGSHVMEYGNNSIKSEKLYLYQGFDPATVNLPLNELPVKSKIGVVNQRDADLLFLWHMYRTSEDGSRKKDDTLKELTETTRHRKHLDASVELIATILFGPTMNVLNLVREPGLPLVDDWECLKSMVRVFEEHCGSLTQYGMKHMRAFANVCNNGVSKELMEEASTAACGGYSEARYTVHPSILGYSA

SEQ ID NO: 177 - DNA, 1401 bp, Arabidopsis thaliana
atgtctagtcctcttggtcactttcagattcttgtttttcttcatgctttgcttatcttctcagctgagtcccgcaaaacccaattgctgaacgataatgatgttgaatctagcgacaagagtgcaaaaggcacacgatgggctgttttagttgctggatcaaatgaatattataactacaggcatcaggctgacatatgccacgcgtatcagatactccgaaaaggcggtttaaaagatgaaaacatcattgtgtttatgtatgatgatatcgcgttttcctcggagaatcctaggcctggagttatcattaataaaccagatggagaagatgtttataaaggagttcctaaggactacactaaagaagctgttaatgttcaaaacttctacaatgtgttacttggaaatgaaagtggcgtcacaggaggaaatggcaaagttgtgaaaagtggtcctaatgataatatcttcatctattatgctgaccatggagctcctggcttaatagcgatgcccactggtgatgaagttatggcaaaagatttcaatgaagtcttggagaagatgcataagagaaaaaaatacaacaagatggtgatctatgttgaagcatgtgaatcaggaagtatgtttgaagggattttaaagaaaaatctcaacatatacgcagtgactgctgctaattctaaagagagcagctggggagtttactgtcctgagtcatatcctcctcctccttctgagattggaacttgtctcggcgatacatttagcatctcttggcttgaggacagtgaccttcatgacatgagcaaagagactttggagcaacaataccacgttgtaaagagaagagtaggatctgatgtaccagagacttctcatgtatgccgtttcggaacagagaagatgcttaaagattatctttcctcttacattggaagaaatcctgaaaacgataacttcactttcacggaatccttttcctcaccaatctctaattctggcttggtcaatccgcgcgatattcctctgctatacctccagagaaagattcaaaaagctccaatgggatcacttgaaagcaaagaagctcagaagaaattgcttgacgaaaagaatcataggaaacaaatcgatcagagcattacagacattctgcggctttcagttaaacaaaccaatgtcttaaatctcttaacttccacaagaacaacaggacagcctcttgtagacgattgggattgcttcaagactctagttaatagcttcaagaatcactgcggtgcaacggtgcattacggattgaagtatacaggagcgcttgccaatatctgcaatatgggagtggatgtgaagcaaactgtttcagccattgaacaagcttgttcgatgtaa

SEQ ID NO: 178 - protein, 466 aa, Arabidopsis thaliana
MSSPLGHFQILVFLHALLIFSAESRKTQLLNDNDVESSDKSAKGTRWAVLVAGSNEYYNYRHQADICHAYQILRKGGLKDENIIVFMYDDIAFSSENPRPGVIINKPDGEDVYKGVPKDYTKEAVNVQNFYNVLLGNESGVTGGNGKVVKSGPNDNIFIYYADHGAPGLIAMPTGDEVMAKDFNEVLEKMHKRKKYNKMVIYVEACESGSMFEGILKKNLNIYAVTAANSKESSWGVYCPESYPPPPSEIGTCLGDTFSISWLEDSDLHDMSKETLEQQYHVVKRRVGSDVPETSHVCRFGTEKMLKDYLSSYIGRNPENDNFTFTESFSSPISNSGLVNPRDIPLLYLQRKIQKAPMGSLESKEAQKKLLDEKNHRKQIDQSITDILRLSVKQTNVLNLLTSTRTTGQPLVDDWDCFKTLVNSFKNHCGATVHYGLKYTGALANICNMGVDVKQTVSAIEQACSM

SEQ ID NO: 179 - DNA, 1506 bp, Oryza sativa
atggcggcgcgcgctcgcctccgcctcgtcctgcccccgctcgcggcgctgctcctcttcgcgcacctcgccgccgtcgcggtggcgcggccgcggtgggaggaggagggcagcaacctccgcctgccgtcggagcgcgccgtggcggctggcgcggcggcggacgacgctgccgaggccgccgagggcaccaggtgggccgtcctcatcgccggctccaacggctactacaactaccgccaccaggcggatgtctgccatgcctaccagatcatgaagaggggcgggctcaaggacgagaacatcatcgtcttcatgtacgatgacatcgcgcacaacccggagaatccgaggcctggtgtcatcatcaaccatccccagggtggcgatgtctatgctggggtcccgaaggattacactgggaaggaggttaatgtcaaaaacttgtttgctgttctgctcggtaacaaaactgctgtcaaaggtgggagtggcaaagtcctggacagtggccccaacgatcatattttcattttttacagtgaccatgggggtcctggtgtccttgggatgccaacctatccatacctctacggtgatgatcttgtagatgttctgaagaagaagcatgctgctgggacgtacaaaagcctggtcttttaccttgaagcctgtgaatctggaagcatctttgagggtctattgccaaatggcatcaatgtttatgccaccactgcatcaaacgctgatgagagcagctggggaacatactgccctggggagtacccgagcccacctccggagtacgacacatgcctaggggacttgtacagcgttgcttggatggaagacagcgatgtccacaacctgagaactgaatcactcaagcagcagtacaatctcgtcaaggaaaggacatctgtgcagcacacatattactctgggtcacatgtgatggaatacggttctttagagctgaatgcccatcatgtgttcatgtacatgggttccaatccggctaacgacaatgctacatttgtggaagataactcgttgccatcgttctcaagggctgttaatcagcgggatgctgacctggtttacttctggcagaagtaccgcaaattgcctgagagttctcctgagaaaaacgaagctcggaagcaattgcttgaaatgatggcacacagatctcatgttgacaacagtgttgagctgatcggaaaccttctctttggctctgaggaaggcccaagggttctaaaggctgttcgtgcaactggcgaacctcttgttgatgactggagttgtctcaagtctatggtacgcactttcgaagcacaatgcggctcgctagcgcagtatggaatgaagcatatgcgttcctttgcaaacatctgcaatgctggcatctctgctgaagcgatggcaaaggttgctgcgcaggcttgcaccagcattccctccaacccctggagttccacccataggggttttagtgcttaa

SEQ ID NO: 180 - protein, 510 aa, Oryza sativa
MAARARLRLVLPPLAALLLFAHLAAVAVARPRWEEEGSNLRLPSERAVAAGAAADDAAEAAEGTRWAVLIAGSNGYYNYRHQADVCHAYQIMKRGGLKDENIIVFMYDDIAHNPENPRPGVIINHPQGGDVYAGVPKDYTGKEVNVKNLFAVLLGNKTAVKGGSGKVLDSGPNDHIFIFYSDHGGPGVLGMPTYPYLYGDDLVDVLKKKHAAGTYKSLVFYLEACESGSIFEGLLPNGINVYATTASNADESSWGTYCPGEYPSPPPEYDTCLGDLYSVAWMEDSDVHNLRTESLKQQYNLVKERTSVQHTYYSGSHVMEYGSLELNAHHVFMYMGSNPANDNATFVEDNSLPSFSRAVNQRDADLVYFWQKYRKLPESSPEKNEARKQLLEMMAHRSHVDNSVELIGNLLFGSEEGPRVLKAVRATGEPLVDDWSCLKSMVRTFEAQCGSLAQYGMKHMRSFANICNAGISAEAMAKVAAQACTSIPSNPWSSTHRGFSASPLAQGYSA

SEQ ID NO: 181 - DNA, 1506 bp, Oryza sativa; identical to SEQ ID NO: 179

SEQ ID NO: 182 - protein, 394 aa, Oryza sativa
MYDDIANNILNPRPGVIVNHPQGEDVYAGVPKDYTGDEVTAKNFYAVLLGNKTAVTGGSRKVIDSKPNDHIFIFYSDHGGPGVLGMPNLPYLYAADFMKVLQEKHASNTYAKMVIYVEACESGSIFEGLMPEDLNIYVTTASNAEESSWGTYCPGMEPSPPSEYITCLGDLYSVSWMEDSETHNLKEESIKKQYEVVKKRTSDMNSYGAGSHVMEYGDRTFKDDKLYLYQGFDPANAEVKNKLSWEGPKAAVNQRDADLLFLWRRYELLHDKSEEKLKALREISDTVMHRKLLDSSVDLVGKLLFGFGNGPSVLQAVRPSGQPLVDDWDCLKRMVRIFESHCGPLTQYGMKHMRAFANICNNGISGASMKEASIATCSSHNSGRWSSLVQGYSA

SEQ ID NO: 183 - DNA, 1494 bp, Oryza sativa
atggctgcgcggtgctgggtatggggcttcgtcgtcgcgctcctggctgtggcggcggcggcggatggggaggaggaggaggggaagtgggagccgctgattcggatgccgacggaggaaggggacgacgctgaggctgctgctcccgctcctgctcctgcggcggcggattacggggggacgaggtgggcggtgctcgtcgccggctcctccggctacgggaactaccggcaccaggccgatgtgtgccatgcgtaccagattctgcagaagggaggagtgaaggaggagaacattgtggtgtttatgtatgatgacattgcccataacattctcaatccaaggcctgggaccatcatcaaccatcctaaaggtggagatgtttatgctggtgttccaaaggactacactggtcaccaggtcaccactgagaacttctttgctgttctcttgggcaataaaaccgcagttactggagggagtgggaaggttatagacagcaaaccagaggatcacatcttcatctattactcagatcatgggggtcctggagttcttggtatgcctaacctgccgtatctttatgctggtgattttattaaagtgttacaaaagaaacatgcttccaacagctactcgaaaatggttatatatgtcgaagcatgtgaaagtggcagtatcttcgagggcttaatgccagaaaatcttaatatttatgtcacaacagcatccaatgcagttgagaatagttggggaacatactgccctggggaggaaccatcacctcctcctgaatatattacatgtctaggtgacatgtacagtgttgcttggatggaggacagtgagactcataatctaaagaaggaaactatcgaggatcagtatgagctggttaaaaaaagaacatcaaatgcaaataagttaaatgagggctctcatgtcatggaatatggtgacaagacattcaaggatgagaagctcttcctctatcaaggttttaatcctgcaaatggcaacatcacaaatgaattgatttggccagtaccaaaggctacagtcaatcaaagagatgccgatcttcttttcatgtggaagaggtatgagcagttgaatggggtgtctgaagacaagctgagggctcttagggagatagaagacaccatagcacacaggaagcatcttgacagcagtatcgatttcatcgggaagcttgtgtttggttttgaaaatgggcctttagcccttgaggctgcaagaagctctggtcaaccattagtcgacaactgggattgtttgaagaagatggtgcgaatttttgaatctcaatgtggatcactcactcagtatggcatgaaatacatgagagcatttgcaaacatatgcaacaacggtgtctctgaggccaaaatgatggaagcaagtatcaacgcttgcggccgttacaactcggcgagatggagcccaatgactgaaggaggacacagtgcttga

SEQ ID NO: 184 - protein, 497 aa, Oryza sativa
MAARCWVWGFVVALLAVAAAADGEEEEGKWEPLIRMPTEEGDDAEAAAPAPAPAAADYGGTRWAVLVAGSSGYGNYRHQADVCHAYQILQKGGVKEENIVVFMYDDIAHNILNPRPGTIINHPKGGDVYAGVPKDYTGHQVTTENFFAVLLGNKTAVTGGSGKVIDSKPEDHIFIYYSDHGGPGVLGMPNLPYLYAGDFIKVLQKKHASNSYSKMVIYVEACESGSIFEGLMPENLNIYVTTASNAVENSWGTYCPGEEPSPPPEYITCLGDMYSVAWMEDSETHNLKKETIEDQYELVKKRTSNANKLNEGSHVMEYGDKTFKDEKLFLYQGFNPANGNITNELIWPVPKATVNQRDADLLFMWKRYEQLNGVSEDKLRALREIEDTIAHRKHLDSSIDFIGKLVFGFENGPLALEAARSSGQPLVDNWDCLKKMVRIFESQCGSLTQYGMKYMRAFANICNNGVSEAKMMEASINACGRYNSARWSPMTEGGHSA

SEQ ID NO: 185 - DNA, 1425 bp, Oryza sativa
atggggcgcggtctcctctgcctgctgctgctgcagctcgtcggcctcgtcgtcgccggcggtgggcggtggcggtggcaggaggagttcctccggctgccgtcgtcggatgagacgacgaggtgggcggtgctgatcgcggggtcgaatgggttctataactaccggcaccaggcggacgtgtgccacgcgtaccagatcatgaggaagggaggcgtggaggagcaaaacatcgtggtgatgatgtacgacgacatcgcccacaaccccgacaaccccaggcctgggctcatcttcaaccacccttccggccccgacgtctacgccggcgtccccaaggattacaccggcgacgacgtcaacgtcaacaacttcctcgccgtcctcctcggcaaccgctccgccctcaccggctccggcagcggcaaggtcgtcgccagcggccccaacgaccacgtcttcgtctactacgccgaccacggcggccccggcgtcctgagcatgccagccgacggcgagtacctgtacgccgacgacctggtcaaggcgctcaagaagaagcacgccggcggcgggtacaagagcctggtcgtgtacgtggaggcgtgcgagtccggcagcatcttcgagggcctcctgccttccgacatctccgtgtacgccaccacggcctccaacgcggaggagagcagctggggcacctactgccccggcgacgaccacgacgccccggcggcggagttcgacacctgcctcggggacctctacagcgtggcgtggatggaggacgcggaggcgcaccaggaggggcgcctcgccgagacgctgcggcagcagtacaggacggtgaagaaccggacgtccgacgagggcacctacacgctcggctcccacgtcatgcagtacggcgacatggcgctcgcaccgcagagcctggacctctactacatggatacatcacctgcgacggcgaacgaccacaaattagctgctgctggcgccaaaggcagccactcctacactgtgtctgtgaatcagcgcgacgccgatctgctctacttgtggcgcaagtaccggagagccggcgaggggacggcagagaaggtggaggctcgggagcggcttgtgcaggagatgggacggcgatcgcgcgtggacagaagcgtggagatgatcgggggcctcctcttgggcggcgccaagcacaagcagcaggttgtgcgggagcgggctgcgctggttgaggactgggagtgcctcaggtcgatggtgcggacgttcgaggatcagtgtgggtcgctgggacagtacgggataaagcacatgcgctccttcgccaacatctgcaacgccggcgtcccccaccacgccatggccaaggccgcctccctggcctgtccatcccctcctccgttacacttatga

SEQ ID NO: 186 - protein, 474 aa, Oryza sativa
MGRGLLCLLLLQLVGLVVAGGGRWRWQEEFLRLPSSDETTRWAVLIAGSNGFYNYRHQADVCHAYQIMRKGGVEEQNIVVMMYDDIAHNPDNPRPGLIFNHPSGPDVYAGVPKDYTGDDVNVNNFLAVLLGNRSALTGSGSGKVVASGPNDHVFVYYADHGGPGVLSMPADGEYLYADDLVKALKKKHAGGGYKSLVVYVEACESGSIFEGLLPSDISVYATTASNAEESSWGTYCPGDDHDAPAAEFDTCLGDLYSVAWMEDAEAHQEGRLAETLRQQYRTVKNRTSDEGTYTLGSHVMQYGDMALAPQSLDLYYMDTSPATANDHKLAAAGAKGSHSYTVSVNQRDADLLYLWRKYRRAGEGTAEKVEARERLVQEMGRRSRVDRSVEMIGGLLLGGAKHKQQVVRERAALVEDWECLRSMVRTFEDQCGSLGQYGIKHMRSFANICNAGVPHHAMAKAASLACPSPPPLHL

SEQ ID NO: 187 - DNA, 1419 bp, Populus trichocarpa
atggagacccacaaggcctattttttgtctgctattttagtgcttgcgatgctgtcttttctacatgtacagagtgttcaagccgcccggttgagcccggttgaaccaaggattcttatgccaacagggaaagatgagccagaagtcgatgatgatggtgaagaaattggctcgagatgggcggttcttgtggccggttcaagtggttatggaaattacaggcatcaggcggatgtctgccatgcatatcaactattaagaaaaggcgggataaaagaagagaacatggtggtgtttatgtatgatgatatagccatgcatcatttgaacccaaggcctggagttatcatcaaccatccacaaggagatgatgtttatgctggtgtgcctaaggattacactggtgaacaggttaatacagagaatctgtatgcagtacttcttggtaacaagagtgctgtcaagggtggaagtggcaaggttgtggatagcaagcccaatgacaggatcttcttgtactattctgatcatggaggtcctggagttcttggaatgccaaatatgccttttctatatgcaatggatttcatcgaggttctgaagaagaaacatgcatctgggagctacaaagaaatggtaatgtatatagaagcttgcgagagtgggagcatcttcgaagggatcatgcctaaggacctaaacatttacgtgacgacagcatcaaatgcggaagagagggatctgtacagtgttgcttggatggaagatagtgaaacacacaatctgaagaaagaaacaattaagcagcaatatcattcggtgaaagagaggacttccaattacaatgcattcacttctggatcccatgtgatgcaatatgggaacgaaagcctcaaaggagagaagctttttttgtatcaaggtttcgatccagctagtgtaaacttccctccaaacaatggccacattggtgcgcgtatggatgttgttaaccagagagatgcagagcttgttttcctctggcaaatgtacaaaagagctgaaggtgggtcagaaaagaagacccaaatcctcaatcagattaaagagacaatgaggcatagaactcacttggacagcagcatggaattgatcggaacactattattaggacctaaaaaaggttccaccatccttaaatctgttagggaacccgattcgcccctagtagatgactggagatgcttaaaatcaatggttcgattgtttgaaacacattgtggatcactgactcagtatggaatgaaacacatgcgagcatttgccaacatttgcaatggtggcgtctctctagcctccatggaggaagcttgtgtggccgcttgtagtggccatgatgctggggaactgcatccttcaaaccaaggttacagtgcttaa

SEQ ID NO: 188 - protein, 472 aa, Populus trichocarpa
METHKAYFLSAILVLAMLSFLHVQSVQAARLSPVEPRILMPTGKDEPEVDDDGEEIGSRWAVLVAGSSGYGNYRHQADVCHAYQLLRKGGIKEENMVVFMYDDIAMHHLNPRPGVIINHPQGDDVYAGVPKDYTGEQVNTENLYAVLLGNKSAVKGGSGKVVDSKPNDRIFLYYSDHGGPGVLGMPNMPFLYAMDFIEVLKKKHASGSYKEMVMYIEACESGSIFEGIMPKDLNIYVTTASNAEERDLYSVAWMEDSETHNLKKETIKQQYHSVKERTSNYNAFTSGSHVMQYGNESLKGEKLFLYQGFDPASVNFPPNNGHIGARMDVVNQRDAELVFLWQMYKRAEGGSEKKTQILNQIKETMRHRTHLDSSMELIGTLLLGPKKGSTILKSVREPDSPLVDDWRCLKSMVRLFETHCGSLTQYGMKHMRAFANICNGGVSLASMEEACVAACSGHDAGELHPSNQGYSA

SEQ ID NO: 189 - DNA, 1512 bp, Populus trichocarpa
atgacgcgactcattgccggcgtaatttttcttcttatttctttctgtggtatcgccgtcggtgtccgagacatcgttggtgacgttctccggttgccatcggaggcttctaggtttttccgtcccggtaaatttaatgatgataatagtgatgatgattcttccggaactagatgggccatcttgcttgccggatctaacggttactggaattaccggcaccaggcagatgtttgtcatgcatatcaactgctgagacaaggtggattgaaggaagaaaatataatagttttcatgtacgatgacattgctgataacccagagaacccaaggcctggagtcatcatcaacaatccccaaggagaagatgtttataaaggagttccaaaggattatactggtccagatgtcaccgttggaaacttttttgcggctatccttggaaacaagacagctcttaccgggggcagtggaaaagttattgatagtgggcccaatgaccatattttcatttattatactgatcatggaggtcctggggtgctagggatgcctaccaatccttacctttatgcggatgatttgattgatgtcttaaaaaagaagcatgcatccggaacctataaaagcttggtgttttatcttgaagcctgtgaatccggaagcatctttgagggtcttcttcctcaaggtctaaatatctatgcaaccacagcatcaaatgcagaagagagcagttggggaacctattgtcctggagagtatcctagccctcccccagaatacgaaacttgtttgggtgacttgtacagtgttgcttggatggaggatagtgacatacacaatttacggacagaaactctgcaccagcaatatgaactggtaaaaaggaggacttcctatgacaattctccctacggttcccatgtcatgcaatatggtgatgttggacttagcaaggacgacctcttccagtatatgggtacaaaccctgcaaatgataactacactttcgtggaggagaactccttgaggccacattctaaagttgttaatcagcgtgatgctgatctcgtccacttctggactaagtaccgcaaggccccagaaggctcttctaggaaggttgaagctcagaagcagtttgttgaagcaatgtcacatagaatgcatattgaccacagcataaaacttattgggaagctcctctttggaattgaaaaggcctcagaggcattgaacaccgtacgtcctgctgggcaacctcttgttgatgactgggtctgccttaagacactggtaaaattttacagttctcagcctctgctttatcacctcctaaccttatgggatgaaacacatgcgatctcttgcaaacctttgcaatgccggaattgtaaaggaacagatggccgaggcatcagcacaagcttgtgtaagctttccttctggttcatggagctctcttcacaaagggttcagcgcctaattgaagcagaatgtcctatttaa

SEQ ID NO: 190 - protein, 503 aa, Populus trichocarpa
MTRLIAGVIFLLISFCGIAVGVRDIVGDVLRLPSEASRFFRPGKFNDDNSDDDSSGTRWAILLAGSNGYWNYRHQADVCHAYQLLRQGGLKEENIIVFMYDDIADNPENPRPGVIINNPQGEDVYKGVPKDYTGPDVTVGNFFAAILGNKTALTGGSGKVIDSGPNDHIFIYYTDHGGPGVLGMPTNPYLYADDLIDVLKKKHASGTYKSLVFYLEACESGSIFEGLLPQGLNIYATTASNAEESSWGTYCPGEYPSPPPEYETCLGDLYSVAWMEDSDIHNLRTETLHQQYELVKRRTSYDNSPYGSHVMQYGDVGLSKDDLFQYMGTNPANDNYTFVEENSLRPHSKVVNQRDADLVHFWTKYRKAPEGSSRKVEAQKQFVEAMSHRMHIDHSIKLIGKLLFGIEKASEALNTVRPAGQPLVDDWVCLKTLVKFYSSQPLLYHLLTLWDETHAISCKPLQCRNCKGTDGRGISTSLCKLSFWFMELSSQRVQRLIEAECPI

SEQ ID NO: 191 - DNA, 1590 bp, Populus trichocarpa
atgttgagtcctggaagttggaacctctctgtatattgcatgcccctatattctaatttctttctagtcgtcagaaagctggttgattacttgaattgcagtatgagcagcagctcctatctgtgtggctatggctatggcacatttcttttcctaatcgcattgttaagttccatagctcaaagtcagggagtgatcatcaacagtactagtgcgtcaagcttgccatcgagtgttagaagagactccactaccgctgaaggaaaacaatgggccgttttggttgccggatcggctggttatgaaaattacaggcatcaggctgatgtatgccatgcataccaaatactgaagaaaggtgggttgaaagatgaaaacatcattgttttcatgtatgatgacattgcgttccatgttgataatcccaggcccggcatcatcatcaacaaaccttttggtcatgatgtttatgcaggagtccccaaggattatactggagataactgtacagtggacaacttatttgctgtacttctgggaaacaaatctgctcttactggagggagtggcaaggttgtggatagtggtccaaatgacaacattttcatatactatgctgatcatggtgctccaggtttagtcggtatgcctattgggaaagacctgtatgccaaagacctcatacaagtgttgaagaagcagcaggaagctaattcgtataaaagcatggtattctaccttgaagcttgtgagtctgggagtatgttcgaaggtcttcttccaagtaactggagcatatatgcaattactgctgcaaatggagaggagagtagctatggaatatattgcccaggatactaccctgctcctcccccagaatttcttacttgcttgggagatgtatttagcatttcttggatggaggatagtgatttgcacgacatgagccaggaaactctgcagcagcaatatgaagtggttcggagaaggacaggatttgattatgaagataggtctcatgtcatgcaatatggaaacatggagcttagtaaggagctgctctcttcttacttgggcacaaacgctgcaaacgataactacgctaccaacattaatatcgaagaatacccttctatgatcccaagagcttttgaccaacgcgaagcaactcttcttcatttctggcacaagtatcaagaagcccccgatggatctgataagaaggccgaggctcacaaggacctacttcgcatacattctcatataaggcatgtggatcgtagcctaagccatattgcttcaactctgtttggggatgaaaacgcagcaaatgcaatgaagcatgttagaccttctgggcaacctcttgttgatgactgggattgcttgaagggccttgtggaagcttatgagaaacagtgtggaggtctgtcatggtatggaaagaagtacacgagagtgatagcaaacatgtgcaatgctgggataaatgtggagcaaatgatcggtgcatccaccagagcatgctcatcaaggaccaccaccaccactcctactagaggctcccttcaaaacgaatttgacaaatag

SEQ ID NO: 192 - protein, 529 aa, Populus trichocarpa
MLSPGSWNLSVYCMPLYSNFFLVVRKLVDYLNCSMSSSSYLCGYGYGTFLFLIALLSSIAQSQGVIINSTSASSLPSSVRRDSTTAEGKQWAVLVAGSAGYENYRHQADVCHAYQILKKGGLKDENIIVFMYDDIAFHVDNPRPGIIINKPFGHDVYAGVPKDYTGDNCTVDNLFAVLLGNKSALTGGSGKVVDSGPNDNIFIYYADHGAPGLVGMPIGKDLYAKDLIQVLKKQQEANSYKSMVFYLEACESGSMFEGLLPSNWSIYAITAANGEESSYGIYCPGYYPAPPPEFLTCLGDVFSISWMEDSDLHDMSQETLQQQYEVVRRRTGFDYEDRSHVMQYGNMELSKELLSSYLGTNAANDNYATNINIEEYPSMIPRAFDQREATLLHFWHKYQEAPDGSDKKAEAHKDLLRIHSHIRHVDRSLSHIASTLFGDENAANAMKHVRPSGQPLVDDWDCLKGLVEAYEKQCGGLSWYGKKYTRVIANMCNAGINVEQMIGASTRACSSRTTTTTPTRGSLQNEFDK

SEQ ID NO: 193 - DNA, 1443 bp, Solanum lycopersicum
atggttcacgtcgccggagttttcatcctcgtcggaatcgccgtgcttgccgccgtcgaaggacgtaatgttttgaaacttccgtcggaagcttccagattcttcgatgacgcagatgactctgttggaaccagatgggccgtccttctcgccggatcaaatggttattggaattatagacatcaggctgatgtatgccatgcgtatcagctattgagaaaaggtggtctcaaagatgaaaatattattgtcttcatgtatgatgacattgctcaccatgaagagaacccaagaccaggagttattattaatagtcctgccggtgaggatgtttacgaaggagttcctaaggattacacgggagatgatgttaatgtgcacaactttttagctgttctccttggtaacaaaactgctcttactggaggtagcggaaaggtggtgaatagtggtccaaatgatcatattttcatattctatagtgatcatggtggccctggcgtgcttgggatgcctaccaatccttatctatatgccgatgatctaattgctgtgttgaaaaagaagcatgcccctgggacatataaaagcttggtattgtacattgaagcttgcgagtctggaagtatatttgagggacttcttcctaatggtctaaatatttatgccacaacagcttcaaatgctgaagaaagcagctggggaacctattgtcctggagaatatcctagtcctcctcctgaatatgagacttgcttgggtgatttgtatgctgtttcctggatggaggacagtgaaatgcacaacttgcggactgaaaatttgaggcagcagtatcacttggtcaaaaagagaactgcaaatggaaatactgcctatggttcccatgtcatgcaatttggtgatctacaactgagtatggagtctctattcaggtttatgggtacaaatcctgcaaatgataactacacttatgtagatgacaattccttgttggcatcatcaaaggctgtcaaccagcgtgatgcagatcttttacatttctgggacaagttccgcaaggctcctgaaggctctgctcggaaagttgaagctcagaaacaattcactgaagctatgtcacacagaatgcacctagatgaacgcattgcccttgttggtaagcttctgtttggaattcaaaaaggtcctgaggtgctgaagcatgttcgatctgcgggtcagcctcttgttgatgattgggcctgccttaaatcttttgtaagaacatttgagtcgcactgcggatcgttatcccaatatggaatgaaacacatgcgttccattgccaatatctgcaatgctggaattcagatggagcagatggtggaggcatcagcacaagcttgtcctagcatcccttccaatatttggagttccctccacaggggctttagtgcgtaa

SEQ ID NO: 194 - protein, 480 aa, Solanum lycopersicum
MVHVAGVFILVGIAVLAAVEGRNVLKLPSEASRFFDDADDSVGTRWAVLLAGSNGYWNYRHQADVCHAYQLLRKGGLKDENIIVFMYDDIAHHEENPRPGVIINSPAGEDVYEGVPKDYTGDDVNVHNFLAVLLGNKTALTGGSGKVVNSGPNDHIFIFYSDHGGPGVLGMPTNPYLYADDLIAVLKKKHAPGTYKSLVLYIEACESGSIFEGLLPNGLNIYATTASNAEESSWGTYCPGEYPSPPPEYETCLGDLYAVSWMEDSEMHNLRTENLRQQYHLVKKRTANGNTAYGSHVMQFGDLQLSMESLFRFMGTNPANDNYTYVDDNSLLASSKAVNQRDADLLHFWDKFRKAPEGSARKVEAQKQFTEAMSHRMHLDERIALVGKLLFGIQKGPEVLKHVRSAGQPLVDDWACLKSFVRTFESHCGSLSQYGMKHMRSIANICNAGIQMEQMVEASAQACPSIPSNIWSSLHRGFSA

SEQ ID NO: 195 - DNA, 1473 bp, Nicotiana tabacum
atgattcgtcacattgccggtactctgttcataattggactcgcacttaacgtcgccgtttcagagagccgtaatgttttgaaacttccgtcagaagtttctagattcttcggtgccgataagagtaatgtcggcgatgatcatgatgacgactccgtcggtaccagatgggctatcctgctagccggatctaacggttattggaattaccgtcaccaggctgatatatgccacgcatatcaactgttgaagaagggtggtctcaaagatgagaacattgttgtgtttatgtacgatgacattgctaacaatgaagagaatccaagaccaggagttatcattaatagccctcatggtgaggatgtttacaaaggagttcctaaggattacactggggatgatgttactgttaacaacttttttgctgctctccttgggaacaaaactgctcttagtggaggcagcggaaaggtggtgaatagtggtccgaatgatcatatcctcatcttctatagtgatcatggcggccctggagtgcttgggatgcctaccgatccttacctctatgcaaacgatctgattgacgtgttgaagaagaagcatgcttccggaacatataaaagcttggtattttaccttgaagcttgtgagtctggtagtatatttgagggtcttcttcctgaaggtttaaatatctatgccacaacagcatcaaatgctgaagagagtagctggggaacctattgtcctggagagtatcccagtcctcctattgaatatgagacttgcctgggtgacttgtacagtatttcctggatggaggacagtgaattacacaacctgcggactgaaagtctgaagcagcagtatcacctggtcagagagagaactgctactgggaatcctgtttatggttcacatgtcatgcaatatggtgatctacatctcagcaaggatgctctatacttatatatgggtacaaatcctgctaatgataattatacttttatggatgacaattccttgcgagtatcaaaggccgttaaccagcgtgatgcagatcttctgcatttttggtacaagttccgcaaggctcctgagggctctgtgaggaaaattgaggctcagaaacagttaaatgaagcaatatcacatagagtgcacttggacaacagcatagcccttgtcggtaaacttctatttggaattaaaaaaggtccagaggtgctaagtagtgtccgccctgctggtcagcctcttgttgatgactgggactgccttaaatcctttgtaagaacatttgagacacattgtggatcgttatcccagtatggaatgaaacatatgcgctccattgctaacatatgcaacgttggaattaagatggcgcagatggtggaggcatcagcacaagcttgtcccagctttgcatccaatacttggagttccctccagaggggttttagtgcatga

SEQ ID NO: 196 - protein, 490 aa, Nicotiana tabacum
MIRHIAGTLFIIGLALNVAVSESRNVLKLPSEVSRFFGADKSNVGDDHDDDSVGTRWAILLAGSNGYWNYRHQADICHAYQLLKKGGLKDENIVVFMYDDIANNEENPRPGVIINSPHGEDVYKGVPKDYTGDDVTVNNFFAALLGNKTALSGGSGKVVNSGPNDHILIFYSDHGGPGVLGMPTDPYLYANDLIDVLKKKHASGTYKSLVFYLEACESGSIFEGLLPEGLNIYATTASNAEESSWGTYCPGEYPSPPIEYETCLGDLYSISWMEDSELHNLRTESLKQQYHLVRERTATGNPVYGSHVMQYGDLHLSKDALYLYMGTNPANDNYTFMDDNSLRVSKAVNQRDADLLHFWYKFRKAPEGSVRKIEAQKQLNEAISHRVHLDNSIALVGKLLFGIKKGPEVLSSVRPAGQPLVDDWDCLKSFVRTFETHCGSLSQYGMKHMRSIANICNVGIKMAQMVEASAQACPSFASNTWSSLQRGFSA

SEQ ID NO: 197 - DNA, 1467 bp, Saccharum officinarum
atggtgaccgctcgcctccgcctcgcgctgctactactctccgtgttcctctgctccgcgtgggcgcgcccacgcctcgagccgaccatccgcctgccgtccgagcgcgccgcggcggcggccggcgacgaaacggacgacgccgtcgggacacggtgggccgtgctcgtcgccggctccagcggctactacaactaccgccaccaggcagacatctgccatgcgtaccagattatgaagaagggaggactcaaggacgagaacataattgtcttcatgtacgatgacatcgcgcatagcgcagagaatccgaggcccggtgtcgtcatcaaccatccccagggtggcgatgtctatgctggggttccaaaggattacactgggcgacaggtcagtgtcaacaatttcttcgctgttctgcttggcaacaaaactgctctgacaggtgggagcggcaaggttgtggacagtggccccaatgatcatatctttgttttctacagtgaccatggaggtcctggtgtccttggaatgcctacgtatccatatctctacggtgatgacctcgtagatgtcctgaagaagaagcatgctgctgggtcctacaaaagcctggtcttttaccttgaagcatgcgaatctgggagcatctttgagggcctcctgccagatgacatcaatgtgtatgcgaccaccgcgtcaaatgcagaggagagcagctgggggacgtactgccctggcgagttcccaagccctccaccggagtatgacacttgcttgggagacctgtatagtgtttcttggatggaagacagtgatttccacaatctgcgaactgaatctctcaagcagcagtacaagttggtcaaggataggacagcggctcaggatacattcagctatggttcccatgtgatgcaatatggttcattggagttgaatgttcagaaattgttttcgtacattggcacaaaccctgctaacgatggcaacacatttgtagaagataactcattgccatcattttcaaaagctgttaatcagcgtgatgctgatcttgtctacttctggcagaagtaccggaaattggctgatggctcatctaagaaaaatgaagctcggaaggaattgcttgaagtgatgtcccaccggtctcatgttgacaacagtgttgaactcattggaagccttctctttggctctgaggacggtccaagggttctgaaagccgtccgtgcagctggtgaacctctggttgatgattggagttgcctcaagtccatggttcgtacttttgaggcgcaatgtgggtcgttggcgcagtatgggatgaagcacatgagaaccttcgcaaacatctgcaacgctggcatccttcctgaagcagtgtcaaaggttgccgctcaggcttgcaccagcattccttccaacccctggagctctatcgacaagggttttagcgcctaa

SEQ ID NO: 198 - protein, 488 aa, Saccharum officinarum
MVTARLRLALLLLSVFLCSAWARPRLEPTIRLPSERAAAAAGDETDDAVGTRWAVLVAGSSGYYNYRHQADICHAYQIMKKGGLKDENIIVFMYDDIAHSAENPRPGVVINHPQGGDVYAGVPKDYTGRQVSVNNFFAVLLGNKTALTGGSGKVVDSGPNDHIFVFYSDHGGPGVLGMPTYPYLYGDDLVDVLKKKHAAGSYKSLVFYLEACESGSIFEGLLPDDINVYATTASNAEESSWGTYCPGEFPSPPPEYDTCLGDLYSVSWMEDSDFHNLRTESLKQQYKLVKDRTAAQDTFSYGSHVMQYGSLELNVQKLFSYIGTNPANDGNTFVEDNSLPSFSKAVNQRDADLVYFWQKYRKLADGSSKKNEARKELLEVMSHRSHVDNSVELIGSLLFGSEDGPRVLKAVRAAGEPLVDDWSCLKSMVRTFEAQCGSLAQYGMKHMRTFANICNAGILPEAVSKVAAQACTSIPSNPWSSIDKGFSA

SEQ ID NO: 199 - DNA, 1461 bp, Zea mays
atggtggccgctcgcctccgcctcgcgctgctactctccgtctgcctctgctccgcgtgggcgcgcccacgcctcgagacggccatccgcctgccgtcgcagcgcgcggcggcggccgacgaaacggacgacggcgccgtcgggacccgctgggctgtgctcatcgcaggctccagcggctactacaactaccgccaccaggcggacatctgccatgcataccagatcatgaagaagggcggactcaaggatgagaacatcattgtcttcatgtacgatgacatcgcgcatagcccggagaatccgaggcctggtgtcatcatcaaccatccccagggtggcgacgtctatgctggggtgccaaaggattacacggggcgagatgtcaacgtcgacaatttcttcgctgttctgcttggcaacaaaactgctctcaggggtgggagcggcaaggttgtggacagtggccccgatgatcatatctttgttttctacagtgaccatgggggtcctggtgtccttggaatgcctacgtatccatatctctatggtgatgacctcgtagatgtcctgaagaagaagcatgctgccgggacctacaaaagcctggtcttttaccttgaagcatgcgaatctgggagcatctttgagggcctcctgccgaatgacatcaatgtgtatgcgaccaccgcgtcaaatgcagaggagagcagctgggggacatactgccctggcgagttcccgagccctccaccggagtatgacacctgcttgggtgacctgtacagtgttgcttggatggaagacagtgatttccacaatctgcgaactgaatctctcaagcagcagtacaagttggtcaaggataggacagcggttcatgacacgttcagctatggttcccatgtgatgcaatatggcgcactggagttgaatgttcagcatttgttttcgtacattggcacagaccctgctaacgatggcaacacgtttatagaagataactcactgccatcgttctcaaaagccgtcaatcagcgcgacgctgaccttgtctacttctggcagaagtaccggaaatttgctgatagcccgcctgcgaaaagcgaggctcggaaggaactgcttgaagtgatggcccacaggtctcatgttgacagcagcgttgagctcatcggaagccttctctttggctctgaggacggtccaagggttctgaaagccgtccgtgcacctggtgaacctctggttgatgattggagctgcctcaagtccatagttcgcacttttgaggcgcgatgcgggtccttggcgcagtatgggatgaagcacatgcgatccttcgcgaacatgtgcaacgctggcatccttcctgaagcagtgtcgaaggtggccgctcaggcctgcagcagcattccgtccaacccctggagctctatccacaagggttttagcgcttaa

SEQ ID NO: 200 - protein, 486 aa, Zea mays
MVAARLRLALLLSVCLCSAWARPRLETAIRLPSQRAAAADETDDGAVGTRWAVLIAGSSGYYNYRHQADICHAYQIMKKGGLKDENIIVFMYDDIAHSPENPRPGVIINHPQGGDVYAGVPKDYTGRDVNVDNFFAVLLGNKTALRGGSGKVVDSGPDDHIFVFYSDHGGPGVLGMPTYPYLYGDDLVDVLKKKHAAGTYKSLVFYLEACESGSIFEGLLPNDINVYATTASNAEESSWGTYCPGEFPSPPPEYDTCLGDLYSVAWMEDSDFHNLRTESLKQQYKLVKDRTAVHDTFSYGSHVMQYGALELNVQHLFSYIGTDPANDGNTFIEDNSLPSFSKAVNQRDADLVYFWQKYRKFADSPPAKSEARKELLEVMAHRSHVDSSVELIGSLLFGSEDGPRVLKAVRAPGEPLVDDWSCLKSIVRTFEARCGSLAQYGMKHMRSFANMCNAGILPEAVSKVAAQACSSIPSNPWSSIHKGFSA

SEQ ID NO: 201 - DNA, 1446 bp, Zea mays
atggtggccgatcgcctccgcctcgcgctgctgctctccgcgtgcctctgctccgcgtgggcgcgcccacgcctcgagccgaccatccgcctgccgtccgaccgcgcggcggccgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaatttcttcgctgttctgcttggcaacaaaactgctctcaggggtgggagcggcaaggttgtggacagtggccccaatgatcatatatctgttttctacagtgaccatgggggtcctggcgtccttggaatgcctacgtatccatatctctatggtgatgacctcgtagatgtcctgaagaagaagcatgctgccgggacctacaaaagcctggtcttttaccttgaagcatgcgaatctgggagcatctttgagggcctcctgccgaatgacataaatgtgtatgcgaccaccgcgtcaaatgcagaggagagtagctgggggacgtactgccctggcgagttcccgagccctccgccggagtatgacacttgcttgggagacctgtatagtgttgcttggatggaagacagtgatttccacaatctgcgaactgaatctctcaagcagcaatacaacttggtcaaggataggacagcggttcaggatacattcagctatggctcccatgtgatgcaatatggttcattggggttgaatgttaagcatctgttttcgtacattggcacaaaccctgctaacgatgacaacacgttcatagaagacaactcgttgccatcattctcaaaggctgttaatcagcgcgacgctgaccttgtctacttctggcagaagtaccggaaattggcagacagctcacctgagaaaaatgaagctcggagggagttgcttgaagtgatggcccacaggtctcatgttgacagcagcgttgagctcattggaagccttctctttggctctgaggacggtccaagggttctgaaagccgtccgtgcagctggtgagcctctggtcgatgattggagctgtctcaagtccacggttcgtacttttgaggcgcaatgtgggtcgttggcgcagtatgggatgaagcacatgcggtccttcgcaaacatctgcaacgctggcatccttcctgaagcagtgtcgaaggtcgctgctcaggcttgcaccagcattccttccaacccctggagttctatccacaagggttttagcgcctaa

SEQ ID NO: 202 - protein, 481 aa, Zea mays
MVADRLRLALLLSACLCSAWARPRLEPTIRLPSDRAAADDAVGTRWAVLIAGSNGYYNYRHQADICHAYQIMKKGGLKDENIVVFMYDDIAHSPENPRPGVIINHPQGGDVYAGVPKDYTGRDVNVDNFFAVLLGNKTALRGGSGKVVDSGPNDHISVFYSDHGGPGVLGMPTYPYLYGDDLVDVLKKKHAAGTYKSLVFYLEACESGSIFEGLLPNDINVYATTASNAEESSWGTYCPGEFPSPPPEYDTCLGDLYSVAWMEDSDFHNLRTESLKQQYNLVKDRTAVQDTFSYGSHVMQYGSLGLNVKHLFSYIGTNPANDDNTFIEDNSLPSFSKAVNQRDADLVYFWQKYRKLADSSPEKNEARRELLEVMAHRSHVDSSVELIGSLLFGSEDGPRVLKAVRAAGEPLVDDWSCLKSTVRTFEAQCGSLAQYGMKHMRSFANICNAGILPEAVSKVAAQACTSIPSNPWSSIHKGFSA

SEQ ID NO: 203 - DNA, 1485 bp, Zea mays
atggctgtgcggtggtgcctcctcctgctcgtgttagtgttggctgcggccgcggcttgcgcggagaagggggagtgggacccggtgattcggatgcctggggagaaggagcctgcagggtcgcactcgcacagcggcgagggattcgatggggaggtggatgacgccgtcgggacgaggtgggcagtgctcgttgccgggtcctccggctacggcaactacaggcaccaggctgatatatgtcatgcgtaccagatactgcaaaaaggaggcataaaagaggagaacattgtggtgtttatgtatgatgacattgccaatagcgcactcaacccaaggcagggggttatcatcaaccacccagagggcgaagatgtttatgctggtgttccaaaggactacactggggaccaagtcactactaagaacttctatgcagttctcttgggcaacaaaactgcagtcactggaggcagcaggaaggtcatcaatagcaaaccagatgaccatatttttatctattactcagatcacgggggccctggtgttcttggtatgcccaatctaccatatctttatgctggtgacttcatgaaggtgttaagagaaaaacatgcttcaaacagctatgccaaaatggttatatatattgaagcatgtgaaagtggcagtatatttgagggattaatgccagaagaccttaatatttatgtcacgacggcatccaatgcagaagaaagtagctggggtacatactgtccaggaatggaaccaccgcctccttctgagtacattacctgcctaggtgatctatatagtgtctcttggatggaagacagtgagactaacaatctgaaggaggaaacagtaaaggaacaatatgaagtggtgaagaagcgtacttcagacttcaatagctatggtgcaggctctcacgtcatggaatatggtgacaagaccttcaaggaagagaagctttacctttatcaaggttttgatcctgcaaatgccaatgtcacaaataagctgctttggtcaggccaagaggctgtggtcaaccaaagggatgcagatattctcttcctatggaagaggtatgagctcttacatgagaagtctgaagagaagcaggaagttctgagggagatcaccggaacagtaaggcataggaagcatctggacaacagcatcaacttcatcggaaagcttctcttcggggctgagaaagggccttccacacttgaggccgtcagacctcccggccagccactcgtcgatgattgggactgcttgaagcaaatggtacggatcttcgaatcccattgcggatcgctcactcagtacggtatgaggcatatgagggcgttcgcaaatatatgcaacagtggcacgcctggcgcttcgatgaagcgagcgagcatgggtgcttgtggcggctacaactcggcgagatggagcccgttggctcagggctacagcgcttga

SEQ ID NO: 204 - protein, 494 aa, Zea mays
MAVRWCLLLLVLVLAAAAACAEKGEWDPVIRMPGEKEPAGSHSHSGEGFDGEVDDAVGTRWAVLVAGSSGYGNYRHQADICHAYQILQKGGIKEENIVVFMYDDIANSALNPRQGVIINHPEGEDVYAGVPKDYTGDQVTTKNFYAVLLGNKTAVTGGSRKVINSKPDDHIFIYYSDHGGPGVLGMPNLPYLYAGDFMKVLREKHASNSYAKMVIYIEACESGSIFEGLMPEDLNIYVTTASNAEESSWGTYCPGMEPPPPSEYITCLGDLYSVSWMEDSETNNLKEETVKEQYEVVKKRTSDFNSYGAGSHVMEYGDKTFKEEKLYLYQGFDPANANVTNKLLWSGQEAVVNQRDADILFLWKRYELLHEKSEEKQEVLREITGTVRHRKHLDNSINFIGKLLFGAEKGPSTLEAVRPPGQPLVDDWDCLKQMVRIFESHCGSLTQYGMRHMRAFANICNSGTPGASMKRASMGACGGYNSARWSPLAQGYSA

SEQ ID NO: 205 - DNA, 1828 bp, Oryza sativa
gcttgagtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtcccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcg

SEQ ID NO: 206 - DNA, 54 bp, Artificial sequence
  primer: forward primer
ggggacaagtttgtacaaaaaagcaggcttaaacaatggccacaacgatgacac

SEQ ID NO: 207 - DNA, 50 bp, Artificial sequence
  primer: reverse primer
ggggaccactttgtacaagaaagctgggtcggtttagggtttctatgcac

SEQ ID NO: 208 - protein, 425 aa, Arabidopsis thaliana
SNSGTRWAVLVAGSSGYWNYRHQADICHAYQLLRKGGLKEENIVVFMYDDIANNYENPRPGTIINSPHGKDVYQGVPKDYTGDDVNVDNLFAVILGDKTAVKGGSGKVVDSGPNDHIFIFYSDHGGPGVLGMPTSPYLYANDLNDVLKKKHALGTYKSLVFYLEACESGSIFEGLLPEGLNIYATTASNAEESSWGTYCPGEEPSPPPEYETCLGDLYSVAWMEDSGMHNLQTETLHQQYELVKRRTAPVGYSYGSHVMQYGDVGISKDNLDLYMGTNPANDNFTFADANSLKPPSRVTNQRDADLVHFWEKYRKAPEGSARKTEAQKQVLEAMSHRLHIDNSVILVGKILFGISRGPEVLNKVRSAGQPLVDDWNCLKNQVRAFERHCGSLSQYGIKHMRSFANICNAGIQMEQMEEAASQACT

SEQ ID NO: 209 - protein, 5 aa, Artificial sequence
  motif caspases
  VARIANT (2)..(2): Xaa is Ala or Gly
EXCES

SEQ ID NO: 210 - DNA, 1128 bp, Oryza sativa
atgctgcttccgccgcatccaggcagaacattaccagcctatcatggagacaacagatttcttcttggagcttgtttcctgagtaaactgcctatgctgcgcccaatgaagttgtctttggtatgcagtgctaatcccaacaaccataggtcaagaagttcggatatcacacgccatcagaagggtggatcagctcggaggaaaagtaagccttaccaggagaaagatgactctgagaatattgatgaattcgatactgatattatgtcctccaaaaatggaccacccatctctttgacaagcaattcccgtcctcaagcaacatcagtcccaggggaaagagagaaggagatagtagagttgtttaaaagggttcaagcacaattgcgagcaaggggaaaagggaaggaggagaagaagcctgaacaagcaaaagcacagggtgagaggggcagtgttgactcccttctaaatctgcttaggaagcactcagtggaccaacgaaggaagagcggtgatgagaaagaacagagtgttgaccaaacaaagagaagcaatgaatctggaaataaacaaaattcaagcatcttcataaagaatgacactcaggaagaacagaaaaagccacatcctgcagccttcaaaaggccagcttcaaattttaggcgaagatcccctgttcctaatgtaaagttccagcctgttaccaatgttgatgccgaacgagtcatcaataacatcaatgatgccgtacaagaggctaagccaactttggaaaataaggctgctacagatgaaccagactcggtttctacattcgaacctaattctgtaatagaaccagaaaacctatctttggatgaccttgatcatatttcagatgatgaacctgatgcttctgatactgatgaacccagtggagaatatgatgagccatctttgcaaatcccaagtgttccaattattgatgaatctcatgatacgacactgaaatcttccttaggaggtcctgatttaagcactttgaaggtcacagaactaagagaacttgcgaaatctcgaggaatcaaaggatattccaagatgaagaagaatgacctggttgaactgctgagcaacatggcttga

SEQ ID NO: 211 - protein, 375 aa, Oryza sativa
MLLPPHPGRTLPAYHGDNRFLLGACFLSKLPMLRPMKLSLVCSANPNNHRSRSSDITRHQKGGSARRKSKPYQEKDDSENIDEFDTDIMSSKNGPPISLTSNSRPQATSVPGEREKEIVELFKRVQAQLRARGKGKEEKKPEQAKAQGERGSVDSLLNLLRKHSVDQRRKSGDEKEQSVDQTKRSNESGNKQNSSIFIKNDTQEEQKKPHPAAFKRPASNFRRRSPVPNVKFQPVTNVDAERVINNINDAVQEAKPTLENKAATDEPDSVSTFEPNSVIEPENLSLDDLDHISDDEPDASDTDEPSGEYDEPSLQIPSVPIIDESHDTTLKSSLGGPDLSTLKVTELRELAKSRGIKGYSKMKKNDLVELLSNMA

SEQ ID NO: 212 - DNA, 1122 bp, Glycine max
atgtcgcaaacgctgcacgctttcgtcgccaaaaaccttggatgtggaatggcatacggcaagtgtctcccatgttcaggtgtttctggaagaactgctgctgtatattcctactcttctctaggtcatcgcagaattcattcccatgtccaagttagaggactaaagtgtggctttaggggtgcatcttttgtatgtgaagcaaagaggaacccagatttctcaaggcaaaacaagcatgggtcctccagaagcagaaatcggaatagtgatgggagagacagctttgagagctttgacgacgatatgttttctttaaaaaatggaccacctgtgtctctttcaacctcaggaaaattccaggccacttcagcccctggtcctagggagaaggagattgttgagctatttaggaaggtccaggctcggctgcgtgagagggctgcctccaaagaagaaaagaaagttgaagcctcccgagcacaaagcaaagagaacagtactgtggattcccttctcaaactactgaagaaacattcagttgagcaagtgaagagaagtagtggaggcagaggaaaagattttagttcagaccagttgcaagaaagtaaccaatacaatggaggacggaactctaaaatttctgatttagatagttctccaaaggatgagccccaagaggacattgtcttctcttcctcggtagccaggcctcggtcaaatttccaaagaaggtctcccgttcctcgtttaaaataccagcatgtctctaacgatgagaatgaaatgactgtagtgccagtaggtagtgaggatacagagaacaatcaggatcagatagatttgaagcttgatgacgaagctgaatctgactttgaatcggatgttgattcaaaggatgagtttttcttcccaaacatagggatggctgaattgtctgaggatgatgattctgagcaaacctataatgatgagagtgtggaggagcagccggcagctcaacacaaggatttgagtgcactgaagctgtccgaattgagggcacttgcaaagactcgtggcctgaaaggattctcaaaaatgaagaagagtgacctcgtggagttgctaactgagacctga

SEQ ID NO: 213 - protein, 373 aa, Glycine max
MSQTLHAFVAKNLGCGMAYGKCLPCSGVSGRTAAVYSYSSLGHRRIHSHVQVRGLKCGFRGASFVCEAKRNPDFSRQNKHGSSRSRNRNSDGRDSFESFDDDMFSLKNGPPVSLSTSGKFQATSAPGPREKEIVELFRKVQARLRERAASKEEKKVEASRAQSKENSTVDSLLKLLKKHSVEQVKRSSGGRGKDFSSDQLQESNQYNGGRNSKISDLDSSPKDEPQEDIVFSSSVARPRSNFQRRSPVPRLKYQHVSNDENEMTVVPVGSEDTENNQDQIDLKLDDEAESDFESDVDSKDEFFFPNIGMAELSEDDDSEQTYNDESVEEQPAAQHKDLSALKLSELRALAKTRGLKGFSKMKKSDLVELLTET

SEQ ID NO: 214 - DNA, 640 bp, tagetes spp
aaagcacaaccaccagcagaaacaataaagatttcatgttagacaaccaacccgagcagaacagttcatttacagaagataaaagtcaaaacgacttgaataaccaggtcacacacgaggtccaagctactgaaaaccgatctacaagacctgtatcaaatttccaaaagaggtcgccaatttctagcttcaaatacaaaccagttttgactggtgaagagtctttcacccctgaaccatttaaaaggaaagaagcaagacatgagcctgagtcaacacctgaggtcaaaatcaagactgggtctgagccagaagttgaaagtcaagcctttgatgggtttgatgaaagttcagatgatgacattgaagaggttgctgatgagattgacgattcagaagaaccaaatgcgattgaagataaggatttgagcagcatgaagctggttgagttaagagcagtggctaaatcaagaggcatcaaggggttgtctaagctgaaaaaagccgagttattggagttgctgactagttgaaagtttacatgttatggaaccttttcattataatgtaccatagaatttgagttgttcttttgatcttttctatctttctatatttatgtgatgttattatctttatg

SEQ ID NO: 215 - protein, 172 aa, tagetes spp
SRNNKDFMLDNQPEQNSSFTEDKSQNDLNNQVTHEVQATENRSTRPVSNFQKRSPISSFKYKPVLTGEESFTPEPFKRKEARHEPESTPEVKIKTGSEPEVESQAFDGFDESSDDDIEEVADEIDDSEEPNAIEDKDLSSMKLVELRAVAKSRGIKGLSKLKKAELLELLTS

SEQ ID NO: 216 - DNA, 996 bp, Brassica napa
gggtcgacaacgaaggagctttttagaatagttcaagctcggctgcgagctcgagcagcgaccaagatggaagataaaaaggcacaagaagaagaagaagaagcttctaaaggacggggaaaagaaagtgaaactgttgactctcttcttaagttactaagaaagcattcgggagagcagagcaaaaaagttaacagttttaacagccatggagacagttcgctacgaggagatcctgtggacaggaggcaagatcgcagcggaggaaaccttgtcaagtcatggaccaaagatcataatgcatcatcatcatcatcatcctttaccaggccagcgtcaagcttcagaagaaagtcgccagtaccaagatttgaatcacctcctccgacttattctaatgaggcaacttttgatgaggcatcgagttacagcgtgacttggacccataagaaggatacagcagagtcgcatgacgaacctgaagacgaacttcaggctgagattgcgcctgagtacgacgaacatgcacctgaatatgagtcagaacctgaccctgtggcagctattctcgaaccagagtcagatctgcatctagacgcatcatcattttaccaagaggaggagcataatgttactttagatgcgttatccgaggaggaggagtctctggatgatgctgatgaagaggttgaggaagaagctgtaaaagacgaggacttgagtacattgaagctgatggaactgagaggcatagcaaaatcaaggggactaaaagggttttcaaagatgaagaaagcccaactcgtggagttgcttagtagtgattccagctgattcgacggtgaaagaatctcaacaaataataagaacatttactctcgttagtgacagtgttgaaatgagttaatttctgtgttctttcttttacctggaaatactggccgtgatcatgtttgtttactcagattttaaactttggtttttgaagatcttcga

SEQ ID NO: 217 - protein, 255 aa, Brassica napa
MEDKKAQEEEEEASKGRGKESETVDSLLKLLRKHSGEQSKKVNSFNSHGDSSLRGDPVDRRQDRSGGNLVKSWTKDHNASSSSSSFTRPASSFRRKSPVPRFESPPPTYSNEATFDEASSYSVTWTHKKDTAESHDEPEDELQAEIAPEYDEHAPEYESEPDPVAAILEPESDLHLDASSFYQEEEHNVTLDALSEEEESLDDADEEVEEEAVKDEDLSTLKLMELRGIAKSRGLKGFSKMKKAQLVELLSSDSS

SEQ ID NO: 218 - DNA, 894 bp, Hordeum vulgare
caactctcactccattagagaacagcaaggaggtcagcttcggttctttggcagaggaagaagagagaagaaatgggagcaattctcatgcagcatcaccaaatctctcgcaatcctctacaaaaagtcatcttccccggatcatttgctctccaaagagatattgttctccatcgcgctccacgacggggttctctaccgtgctcatcttcattgacggtcagagcagaagccaacgggtactcaccttcaagaatggcggtcaagaagcacagcaaagaagagctcatagaattcttcggggccatccaggccgccattgccagggactcgcccaaggcgcccgggaggacgaggaagccgtcgtcgccggctgacacgctcgaagaggctggcacgaagatgcaaccatacgaggaactgcaccaagacgggcagccaaatttggaggacatgaaggtgcctgagctgagggacatggcgagggagagggggatgagaggttactccaagctgaagaaaggggagctgattgatcgtctgaggggtgcctggtcgtctgataattaacaagccttcctctccgagataggaacaggcagccgccagtgctggctgtttggcccaattggtgcagcttacaatcgacttttcttgcgtctgttgttttctttgttagatacagtatcttccaaagaggcagaagctctgcagttggacactaggtctgcattgttttcttgcatctatcctttgcatggtctgtttgtactccctccctacctaaataattgtagttgggaagtacagagggagtagttttgttgctttcattttcgtatcgtcaagtttctgaatttcaacccaccttacgataaaaaaaaaaaaaaaaaa

SEQ ID NO: 219 - protein, 165 aa, Hordeum vulgare
MGAILMQHHQISRNPLQKVIFPGSFALQRDIVLHRAPRRGSLPCSSSLTVRAEANGYSPSRMAVKKHSKEELIEFFGAIQAAIARDSPKAPGRTRKPSSPADTLEEAGTKMQPYEELHQDGQPNLEDMKVPELRDMARERGMRGYSKLKKGELIDRLRGAWSSDN

SEQ ID NO: 220 - DNA, 348 bp, Triticum aestivum
agcctccccgtacgaacccgactctgtgatagcaccagaagatgcatctctggacgactttgttgtctcagacgatgaatcagacgtgctagataccgatgaacccgatgagtacctggaaccattcgataatgctgatgatgttacagatagcatcccatcccatgatgacagtctggaaggtagtccttccgtggaagcttccgacctgagctcgctcaaggtcatggagctgagggagctggcgaaatctcggggactcaggggctactcgaagatgaagaagagcgacctggtcgcactactgagcgacgtgtcctgatccgtcggtggtggcaatcctgcttg

SEQ ID NO: 221 - protein, 105 aa, Triticum aestivum
SPYEPDSVIAPEDASLDDFVVSDDESDVLDTDEPDEYLEPFDNADDVTDSIPSHDDSLEGSPSVEASDLSSLKVMELRELAKSRGLRGYSKMKKSDLVALLSDVS

SEQ ID NO: 222 - DNA, 398 bp, Triticum aestivum
cggaaacaaatgccccagcacggcttacagctttacttatttttaactctaataacagggttcagctaatcgactaacaaagctaggacatgacagcaaaagggaccagcaagagatcaacgaacaacggagaaaaggttaaccctgctcatttacaacgttctatctaaaagggacttggcagaataggaaatgggaggtcgtgcacatggccatggcagaaggggagcaaaacggtgggctcgagcaggattgccaccaccggcggatcaggacacgtcgctcagtagcgcgaccaggtcgctcttcttcatcttcgagtaaccccggagtccccgagatttcgccagctccctcagctccgtcaccttgagcgagctcaggtcggaagcttctgc

SEQ ID NO: 223 - protein, 64 aa, Triticum aestivum
ASDLSSLKVTELRELAKSRGLRGYSKMKKSDLVALLSDVSDPPVVAILLEPTVLLPFCHGHVHD

SEQ ID NO: 224 - DNA, 701 bp, Zea mays
atctggacactgatgacgatcgcaagtccatcggcagtaatgccgtggatgccgtacagaaagctaagacagctcttgatgagaggactgctacagatgagcctgactccatgtctccatatgagccagattctgtaatagaaccaggaaacatttctttgaatgacctcgatgacattttagatgacgacgaagaattcgatgcagatgaaccagacgacgagtatccagaaccttctttgggaatctctgatgtcacagatacggatgagtcgcacgagaacgactccacccccacgggaagtgcggatctaagctctctgaaggttgcggagctgagagagctcgcaaagtctcgaggaatcaaagggtactcgaagaagaagaaaaacgagctggttgaagtgttgagcagcagcatggattgatgataaagtgggtgacctggcgctctgtttgaagtttgaacccactttgcttggccccctctagaaaattgtaaatgagcaaggctaactctgttccggtctgtgctgatcttttgctggttcattttgtacgcctagcttggtagccgtttagctgaattctgtggtgagtggagtaaggtagctgagagccttagctgtttgtgtactaaatcaatgcactgcatccgttctagggtgttgctcgtctgttttccgatattgtcttgttct

SEQ ID NO: 225 - protein, 151 aa, Zea mays
  UNSURE (1)..(1): Xaa can be any naturally occcurring amino acid
XLDTDDDRKSIGSNAVDAVQKAKTALDERTATDEPDSMSPYEPDSVIEPGNISLNDLDDILDDDEEFDADEPDDEYPEPSLGISDVTDTDESHENDSTPTGSADLSSLKVAELRELAKSRGIKGYSKKKKNELVEVLSSSMDDDKVGDLAL

SEQ ID NO: 226 - DNA, 1014 bp, Zea mays
atcaagactagcttgtttgaccaccagcttccctaccttctcctgcaatcccaagagaagatgaattggtttgtatcatcattcatttgcctgtggcaggaagtggatggaagcaggcggtcattggaaggcaggaacagggggctttgcttggtgttctttggaggagaaagaagagcaaagaaatgggaggcttgctcttgtcgcatcaccaaacctttccaaattctttgcaagcttccatccccggacctctctctcttcacaaaggcgaccgcaaaaacctccattgcttggcacctgatgtgcacctcctctgttccctgcggcaaggctttccacgctcatcttggtcggccgtcatcagatcagaagccagcggcaacgcggtggcgtcgccaggcacggtcatcaagcgtagcaaggaggagctcatcaccttcttcagagacatacagacatccattgccgagtgctcgcgtaaagcttccaagaggacgaggaagcagccgcctgatctgttccaagaggtccgcaggagggaggaacagtcacacggtggaggagatagcggcaccgacgacgtttcagagggaccgaggaaagtgaagagtcttgaggacatgaacgtggctggattgagagagttggcgagggccagaaggatgaggggttactccaagcttaagaagggcgagctcattgatcggttgagaggggctactacgtaataaactaccatgatgcagagcagcttcgcagttaatagggacacatgttcttttcgaacgtatgatgagattaccgatcaaaaaattgtatgatgatgagattaccgactttccaaacgatctagtcagttcattgataagaactagaacaatgtgtgtagttattatactatagaaccggtggagctgtattgttgtactacgccgaaacttttgtgtaggcatggcaatctcctgttgttacgtaagttactttgttatgtacggaattagtttctctaaa

SEQ ID NO: 227 - protein, 189 aa, Zea mays
  UNSURE (22)..(22): Xaa can be any naturally occuring amino acid
  UNSURE (146)..(146): Xaa can be any naturally occuring amino acid
  UNSURE (172)..(172): Xaa can be any naturally occuring amino acid
SCRITKPFQILCKLPSPDLSLXHKGDRKNLHCLAPDVHLLCSLRQGFPRSSWSAVIRSEASGNAVASPGTVIKRSKEELITFFRDIQTSIAECSRKASKRTRKQPPDLFQEVRRREEQSHGGGDSGTDDVSEGPRKVKSLEDMNVXWIERVGEGQKDEGYSKLKKGELIDRXERGYYVINYHDAEQLRS

SEQ ID NO: 228 - DNA, 688 bp, Triticum aestivum
gaggcagaaagctaagacagttcttgatgagaggactgttacagatgagcctgactccatgtctccgtatgaacctgattctgtaatagaaccagaaaatatttctttggaagaccttgatgacattttagatgacgatgaagaatctgatacagatgaaccagacgatgagtatccagaaccttctttggaaatcactgatgttacagatacagatgaattgcacgagaacaactccacggaaagttcagatctaacctctctgaaggttgcagagctgagagagcttgcaaagtcccgaggaatcaaaggctattcaaagatgaagaaaaacgagctgattgaagtggtgagcagcagcatggcttgatgataagcgggtgatattgtcaacctttcagtcccactttgctgattgaagtggtgagcagcagcatggctattccatttgaacccactttgcttggcctgatccgctgcctttcagtcccgtagaaaattgtaaatgagcgaggctaacattgttctggtctgtgctgatcttttgctggttctcattttgtacgcctagtttgctagacatttagctgaattgtgtgccgagtggagtaaggtagctgagagcctgagatgctgtttgtgtactaaatgaatgcaccacatctgttctaggtgttgttaaaaaaaa

SEQ ID NO: 229 - protein, 122 aa, Triticum aestivum
RQKAKTVLDERTVTDEPDSMSPYEPDSVIEPENISLEDLDDILDDDEESDTDEPDDEYPEPSLEITDVTDTDELHENNSTESSDLTSLKVAELRELAKSRGIKGYSKMKKNELIEVVSSSMA

SEQ ID NO: 230 - DNA, 1902 bp, Oryza sativa
atggccatctgtatgtccaacttctatgtatctatatatcttgtgtactgcgaacccttcaatctgaaacatttagttttcgtccttattcattactatgctattgtttcttgggtttcaggcagaacattaccagcctatcatggagacaacagatttcttcttggagcttgtttcctgagtaaactgcctatgctgcgcccaatgaagttgtctttggtatgcagtgctaatcccaacaaccataggtcaagaagttcggatatcacacgccatcagaagggtggatcagctcggaggaaaagtaagccttaccaggagaaagatgactctgagaatattgatgaattcgatactgatattatgtcctccaaaaatggaccacccatctctttgacaagcaattcccgtcctcaagcaacatcagtcccaggggaaagagagaaggagatagtagagttgtttaaaagggttcaagcacaattgcgagcaaggggaaaagggaaggaggagaagaagcctgaacaagcaaaagcacagggtgagaggggcagtgttgactcccttctaaatctgcttaggaagcactcagtggaccaacgaaggaagagcggtgatgagaaagaacagagtgttgaccaaacaaagagaagcaatgaatctggaaataaacaaaattcaagcatcttcataaagaatgacactcaggaagaacagaaaaagccacatcctgcagccttcaaaaggccagcttcaaattttaggcgaagatcccctgttcctaatgtaaagttccagcctgttaccaatgttgatgccgaacgagtcatcaataacatcaatgatgccgtacaagaggctaagccaactttggaaaataaggctgctacagatgaaccagactcggtttctacattcgaacctaattctgtaatagaaccagaaaacctatctttggatgaccttgatcatatttcagatgatgaacctgatgcttctgatactgatgaacccagtggagaatatgatgagccatctttgcaaatcccaagtgttccaattattgatgaatctcatgatacgactctgaaatcttccttaggaggtcctgatttaagcactttgaaggtcacagaactaagagaacttgcgaaatctcgaggaatcaaaggatattccaagatgaagaagaatgacctgagccaaggtactgattgggaggatttcctgggaattgtctgcctcccgattatcaattcaacaatcagcttcattaaggaaaacaatgcaggcgatgcagctgctgcactcatgtcccggttggcgctaaaaacaaaggttcttagagatgagcagtggcaagagcttgatgcttccacattggtacctggggatataatcagcatcaggtttggtgacattgtccctgcagatgcgtgcctacttgagggagatcctctgaaaatgaattgccacacgccgttcatgcgaaagatgtcgatcactggaattcagctctcactggtgaatcccttcctgtcaccaaaagaaccggggaccatagtgttcactggctcaacatgcaagcatggtgagattgaagctgttgtcattgcaactgggatacactctttctttggcaaggcagctcatctagtggactccactgaggttgttgggcattttcagaagctttgcgttttcttctccttatcacaaagaatgcaaggactgccccagagcttccaccaaaacatgaaccaccattgtcttgacctgggctgtttggacggtttggtggaggggggagctgtatatgatggaggtggtggatttccgtcaattctgtacacaaggatcataataggtcagtgtacaactctcatttttgcatgttcataa

SEQ ID NO: 231 - protein, 633 aa, Oryza sativa
MAICMSNFYVSIYLVYCEPFNLKHLVFVLIHYYAIVSWVSGRTLPAYHGDNRFLLGACFLSKLPMLRPMKLSLVCSANPNNHRSRSSDITRHQKGGSARRKSKPYQEKDDSENIDEFDTDIMSSKNGPPISLTSNSRPQATSVPGEREKEIVELFKRVQAQLRARGKGKEEKKPEQAKAQGERGSVDSLLNLLRKHSVDQRRKSGDEKEQSVDQTKRSNESGNKQNSSIFIKNDTQEEQKKPHPAAFKRPASNFRRRSPVPNVKFQPVTNVDAERVINNINDAVQEAKPTLENKAATDEPDSVSTFEPNSVIEPENLSLDDLDHISDDEPDASDTDEPSGEYDEPSLQIPSVPIIDESHDTTLKSSLGGPDLSTLKVTELRELAKSRGIKGYSKMKKNDLSQGTDWEDFLGIVCLPIINSTISFIKENNAGDAAAALMSRLALKTKVLRDEQWQELDASTLVPGDIISIRFGDIVPADACLLEGDPLKMNCHTPFMRKMSITGIQLSLVNPFLSPKEPGTIVFTGSTCKHGEIEAVVIATGIHSFFGKAAHLVDSTEVVGHFQKLCVFFSLSQRMQGLPQSFHQNMNHHCLDLGCLDGLVEGGAVYDGGGGFPSILYTRIIIGQCTTLIFACS

SEQ ID NO: 232 - DNA, 411 bp, Oryza sativa
atgggattctgctttgtcctccacggaatagcttctcatgctcatcgttggggagcatcaggtcagaagcaaatggatctccgttgccaagaacggttaataggcgtagcaaagaagagctcattgagttcttcaaaagcatccagacctccattgccgaggaatcgccaagaacttcgaggaggacgaggaagcaatcatctgacccgttcgaagaggttgagaggaggaagcagtcatacgctaggcatagctgatgtttcggaggaacatgcagatggggagccaaaggcgctggatctgaatgatatgaaggtggctgagctgagagaattggcgagggcgagaaggatgaaaggttactcgaggctgaagaagagtgagctgattgatcgtctgaagggtgtctga

SEQ ID NO: 233 - protein, 136 aa, Oryza sativa
MGFCFVLHGIASHAHRWGASGQKQMDLRCQERLIGVAKKSSLSSSKASRPPLPRNRQELRGGRGSNHLTRSKRLRGGSSHTLGIADVSEEHADGEPKALDLNDMKVAELRELARARRMKGYSRLKKSELIDRLKGV

SEQ ID NO: 234 - DNA, 777 bp, Musa balbisiana
atggattttatgtccaaaaatgggtcattgctttctccaagtactaatactagatatcaggctactgcaacttcaggacaaagagagagagaaatagttgagctgtttcggaaagttcaagcacaattacgagagcgggctgcaatcaaggaagagaagaagattgaagccgcacaacagggtcaaagcaagaagggaactgtcgattcggttctcaaattattaaggaggcattcaggggatcagaagaagacaactagtccaggagaggaattttctgttgaccaagtagaaagaagcaacacatttgaggatgagcagaatataaatccctttggccctagtgatagcaagtcacaggagtctgatgtacgaggccctcttccttctgctaggcctgcctcaaattttggtagaaaatctcctgttcctagaatggagttccaagctgtactttcagcagaggaggatatcaactctgctccttccaagtcacgagggagaaggaagaagactggcgattatgagtgtgtgcaagcagcacctgcggagtctgttgtgttggatggtccagatgagttatcatcagatgatcagttggatcattctggttctgatgaaacagctgaagaaactatagaatcatcttctacggaagcttctcctgatttgggttccttgaaactttcagaattgagggatcttgcaaggtatcgaggggtcaaagggtattccaaactcaagaaaggagaactggctgaattattgagtgcttga

SEQ ID NO: 235 - protein, 258 aa, Musa balbisiana
MDFMSKNGSLLSPSTNTRYQATATSGQREREIVELFRKVQAQLRERAAIKEEKKIEAAQQGQSKKGTVDSVLKLLRRHSGDQKKTTSPGEEFSVDQVERSNTFEDEQNINPFGPSDSKSQESDVRGPLPSARPASNFGRKSPVPRMEFQAVLSAEEDINSAPSKSRGRRKKTGDYECVQAAPAESVVLDGPDELSSDDQLDHSGSDETAEETIESSSTEASPDLGSLKLSELRDLARYRGVKGYSKLKKGELAELLSA

SEQ ID NO: 236 - DNA, 1206 bp, Arabidopsis thaliana
atggcgatgtcgggaactttccatttgacttctgactatgtccctggttacacactttcagacagccgttgcttctttaactctgctgtttcaagaagaacacttgccatattaccttgctcttcctgtctcgatcacaagaatgggcgtctgaaatctgtccccaatagaagttcttttgtgtgccgagcaagttctggcggctataggagaaatcctgatttctcaagacttaataagcatggttaccggggaaacaacaggcaaagcggagggagagaagattttgatatcgaaaactctgatatgttgtcttcaagaaatgggcctttattcaacctgtctagttcccccaaattccaagctacctcatcccctggacctagagagaaagagatcgtggagcttttcagaaaggttcaagctcagctccgagctcgtgctgcagcaaagaaagaagaaaaaaagattgaagaagcttctaaagggcagggaaaagaaagtgaaactgttgactctcttcttaagttactaaggaagcactcgggagagcaaagcaagaggcaagttagcaaatttagcagccagggagaagtacaaggagatactgttgacaaacaagatcgcaccggaaatcttgtcacttcagggaacaaagataataatgcatcatcctttaccagaccaacatcaagcttcagaagaaagtcgccagtaccaagatctcaatcaccgccagcttattctagcgaggcaacttttgatcaatcatcaagttacagtgtaacctggacccagaagaaggatacagtagagttgcatgatgagcctgaacatgagcctgcgtatgagcatgagcatgagcctgaaaatgagtcagaacctgggcctgtgacaactatgcttgaaccagattcagagctgaaaccagagtcatcatcattttatcaagaggaggaggatgatgatgttacttttgatgtgttatcacaggatgatggtattttagatgtgttatcagatgatgatgagtctctcgatgatgctgatgaagatagtgatgaagctgaggaagaagccgtgaaagacttgagtgaattgaagctggtcgaacttagaggcatagcaaagtcacggggactaaaagggttgtcaaagatgaagaaagccgaattagtggagttgcttggtagtgattccagctga

SEQ ID NO: 237 - protein, 401 aa, Arabidopsis thaliana
MAMSGTFHLTSDYVPGYTLSDSRCFFNSAVSRRTLAILPCSSCLDHKNGRLKSVPNRSSFVCRASSGGYRRNPDFSRLNKHGYRGNNRQSGGREDFDIENSDMLSSRNGPLFNLSSSPKFQATSSPGPREKEIVELFRKVQAQLRARAAAKKEEKKIEEASKGQGKESETVDSLLKLLRKHSGEQSKRQVSKFSSQGEVQGDTVDKQDRTGNLVTSGNKDNNASSFTRPTSSFRRKSPVPRSQSPPAYSSEATFDQSSSYSVTWTQKKDTVELHDEPEHEPAYEHEHEPENESEPGPVTTMLEPDSELKPESSSFYQEEEDDDVTFDVLSQDDGILDVLSDDDESLDDADEDSDEAEEEAVKDLSELKLVELRGIAKSRGLKGLSKMKKAELVELLGSDSS

SEQ ID NO: 238 - DNA, 756 bp, Arabidopsis thaliana
atggacttggctcttcattgtcattgtgcttacccgttgatcaaactaggattcatgagagctaaatcagccaatcatcttcatgttcgagatactcattcactgccgtttgcgttgcgctttgagcagagtctttcgagaacaacgattaatggagatagaagtatttggtttcaagagaaaggtggttcttcttatacttcaatgggaagatccaagaaaggatgtgtttgttgcaagaaaccgtctgatagacgaacgtcaaacccaagtaaatcgaaccaagaggagatcatttcgctcttgaaacggattcaatcttcgatctctaaaggagagtctcgaggagtcgaggaagagaagaacagcgatgagtcttctaaggaaaagccgctgaccaaagctattcttgacgttcttgagaaatcaagaaaaaaaactgagggtaatcaactatgctttggagatactagtgtgaaggagaagccaccaaagagacaagtagagcttcctcgaccaccgtctagttttgtcaagagaactcctttatcttcttctgcctcaggtccaagaggtaagctcccagtatcaaacagcgataaagctttaggaaaattgacaaagaaggaagagaaagcttcactgatagaaactatgaaacttgcagagctcaaagaagttgcaaagaacagaggaatcaaaggatactcaaagttgaggaagagtgaactattggagctgataagatcgtcctga

SEQ ID NO: 239 - protein, 251 aa, Arabidopsis thaliana
MDLALHCHCAYPLIKLGFMRAKSANHLHVRDTHSLPFALRFEQSLSRTTINGDRSIWFQEKGGSSYTSMGRSKKGCVCCKKPSDRRTSNPSKSNQEEIISLLKRIQSSISKGESRGVEEEKNSDESSKEKPLTKAILDVLEKSRKKTEGNQLCFGDTSVKEKPPKRQVELPRPPSSFVKRTPLSSSASGPRGKLPVSNSDKALGKLTKKEEKASLIETMKLAELKEVAKNRGIKGYSKLRKSELLELIRSS

SEQ ID NO: 240 - protein, 35 aa, Artificial sequence
  motif 1: SAP-consensus
  UNSURE (1)..(1): Xaa can be any naturally occurring amino acid
  UNSURE (8)..(8): Xaa can be any naturally occurring amino acid
  UNSURE (28)..(28): Xaa can be any naturally occurring amino acid
XLSSLKVXELRELAKSRGIKGYSKMKKXELVELLS

SEQ ID NO: 241 - protein, 61 aa, Artificial sequence
  motif 2: consensus
  UNSURE (3)..(3): Xaa can be any naturally occurring amino acid
  UNSURE (14)..(15): Xaa can be any naturally occurring amino acid
  UNSURE (18)..(18): Xaa can be any naturally occurring amino acid
  UNSURE (21)..(22): Xaa can be any naturally occurring amino acid
  UNSURE (24)..(24): Xaa can be any naturally occurring amino acid
  UNSURE (26)..(26): Xaa can be any naturally occurring amino acid
  UNSURE (28)..(30): Xaa can be any naturally occurring amino acid
  UNSURE (32)..(32): Xaa can be any naturally occurring amino acid
  UNSURE (37)..(39): Xaa can be any naturally occurring amino acid
  UNSURE (41)..(42): Xaa can be any naturally occurring amino acid
  UNSURE (49)..(49): Xaa can be any naturally occurring amino acid
  UNSURE (56)..(56): Xaa can be any naturally occurring amino acid
  UNSURE (59)..(59): Xaa can be any naturally occurring amino acid
EKXEIVELFKKVQXXLRXRAXXKXEXKXXXEXAKAQXXXEXXTVDSLLXLLRKHSXDQXKK

SEQ ID NO: 242 - protein, 13 aa, Artificial sequence
  motif 3: consensus
  UNSURE (3)..(3): Xaa can be any naturally occurring amino acid
  UNSURE (5)..(5): Xaa can be any naturally occurring amino acid
  UNSURE (7)..(7): Xaa can be any naturally occurring amino acid
RPXSXFXRRSPVP

SEQ ID NO: 243 - protein, 35 aa, Artificial sequence
  motif 1 of SEQ ID NO: 02
DLSTLKVTELRELAKSRGIKGYSKMKKNDLVELLS

SEQ ID NO: 244 - protein, 56 aa, Artificial sequence
  motif 2 of SEQ ID NO: 02
EKEIVELFKRVQAQLRARGKGKEEKKPEQAKAQGERGSVDSLLNLLRKHSVDQRRK

SEQ ID NO: 245 - protein, 13 aa, Artificial sequence
  motif 3 of SEQ ID NO: 02
RPASNFRRRSPVP

SEQ ID NO: 246 - DNA, 1264 bp, Oryza sativa
tcgacgctactcaagtggtgggaggccaccgcatgttccaacgaagcgccaaagaaagccttgcagactctaatgctattagtcgcctaggatatttggaatgaaaggaaccgcagagtttttcagcaccaagagcttccggtggctagtctgatagccaaaattaaggaggatgccaaaacatgggtcttggcgggcgcgaaacaccttgataggtggcttaccttttaacatgttcgggccaaaggccttgagacggtaaagttttctatttgcgcttgcgcatgtacaattttattcctctattcaatgaaattggtggctcactggttcattaaaaaaaaaagaatctagcctgttcgggaagaagaggattttgttcgtgagagagagagagagagagagagagagagagagagagaaggaggaggaggattttcaggcttcgcattgcccaacctctgcttctgttggcccaagaagaatcccaggcgcccatgggctggcagtttaccacggacctacctagcctaccttagctatctaagcgggccgacctagtagccacgtgcctagtgtagattaaagttgccgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacagctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaatacctccctaatcccatgatcaaaaccatctcaagcagcctaatcatctccagctgatcaagagctcttaattagctagctagtgattagctgcgcttgtgatc

SEQ ID NO: 247 - DNA, 54 bp, Artificial sequence; identical to SEQ ID NO: 206
  primer: upstream primer

SEQ ID NO: 248 - DNA, 50 bp, Artificial sequence; identical to SEQ ID NO: 207
  primer: downstream primer

SEQ ID NO: 249 - DNA, 1568 bp, Oryza sativa
cccacgcgtccgcccacgcgtccgggacaccagaaacatagtacacttgagctcactccaaactcaaacactcacaccaatggctctccaagttcaggccgcactcctgccctctgctctctctgtccccaagaagggtaacttgagcgcggtggtgaaggagccggggttccttagcgtgagcagaaggccaagaagccgtcgctggtggtgagggcggtggcgacgcggcgggccggtggcgagccccggcgcgggcacgtcgaaggcggacgggaagaagacgctgcggcagggggtggtggtgatcaccggcgcgtcgtcggggctcgggctcgcggcggcgaaggcgcttggcggagacggggaagtggcacgtggtgatggcgttccgcgactttcctgaaggcggcgacggcggcgaaggcggcggggatggcggcggggagctacaccgtcatgcacctggacctcgcctccctcgacagcgtccgccagttcgtggacaacttccggcgctccggcatgccgctcgacgcgctggtgtgcaacgccgcacatctaccggccgacggcgcggcaaccgacgttcaacgccgacgggtacgagatgagcgtcggggtgaaccacctgggccacttcctcctcgcccgcctcatgctcgacgacctcaagaaatccgactacccgtcgcggcggctcatcatcctcggctccatcaccggcaacaccaacaccttcgccggcaacgtccctcccaaggccgggctaggcgacctccgggggctcgccggcgggctccgcgggcagaacgggtcggcgatgatcgacggcgcggagagcttcgacggcgccaaggcgtacaaggacagcaagatctgtaacatgctgacgatgcaggagttccaccggagattccacgaggagaccgggatcacgttcgcgtcgctgtacccggggtgcatcgcgacgacgggcttgttccgcgagcacatcccgctgttccggctgctgttcccgccgttccagcggttcgtgacgaaggggttcgtgtcggaggcggagtccgggaagcggctggcgcaggtggtgggcgacccgagcctgaccaagtccggcgtgtactggagctggaacaaggactcggcgtcgttcgagaaccagctctcgcaggaggccagcgacccggagaaggccaggaagctctgggacctcagcgagaagctcgtcggcctcgtctgagtttattatttacccattcgtttcaactgttaatttcttcggggtttagggggtttcagctttcagtgagagaggcctgtcaagtgatgtacaattagtaatttttttttacccgacaaatcatgcaataaaaccacaggcttacattatcgatttgtccacctaaattaagtttcaactgttaatttcttcggggtttagggggtttcagctttcagtgagagaggcctgtcaagtgatgtacaattagtaatttttttttacccgacaaatcatgcaataaaaccacaggcttacattatcgatttgtccacctaaattaagt

SEQ ID NO: 250 - DNA, 1227 bp, Chlamydomonas reinhardtii
atgcaggtcaccatgaagagcagcgccgtcagcggccagcgcgtgggcggtgcccgcgtcgccacccgtagcgtgcgccgggcgcagctgcaggttgtggcctctagccgcaagcagatgggccgctggcggtcgatcgacgcgggcgtcgacgcgtccgatgaccagcaagacatcactcgcggccgcgagatggtggacgacctgttccagggcggcttcggtgccggcggcacccacaacgcagtgctgtccagccaggagtacctgagccagagccgcgcctcgttcaacaacattgaggacggcttctacatctcgcccgctttcctggacaagatgaccatccacattgccaagaacttcatggacctgcccaagatcaaggtgcccctcattctgggtatctggggtggcaagggccagggcaagaccttccagtgcgcgctcgcctacaagaagctgggcattgcccccatcgtcatgtccgctggtgagctggagtccggcaacgccggtgagcccgccaagctgatccgcacccgctaccgggaggcctccgacatcatcaagaagggccgcatgtgctcgctgttcatcaacgatctggacgccggtgccggccgcatgggcgacaccacccagtacaccgtgaacaaccagatggtgaacgccaccctgatgaacatcgccgacaacccgaccaacgtccagctgcccggtgtgtacaagaacgaggagatccctcgcgtgcccattgtgtgcacgggcaacgacttctccaccctgtacgcgcccctgatccgcgatggccgcatggagaagtactactggaaccccacccgcgaggaccgcatcggcgtgtgcatgggcatcttccaggaggacaacgttcagcgccgcgaggtggagaacctggtggacaccttccccggccagtccattgacttcttcggcgccctgcgtgcccgcgtgtacgacgacatggtgcgccagtggatcaccgacaccggcgtggacaagatcggccagcagctggtcaacgcccgccagaaggtggccatgcccaaggtgtccatggacctgaacgtgctgatcaagtacggcaagtcgctggtggacgagcaggagaacgtcaagcgcgtgcagctggccgatgcctacctgtcgggcgccgagctggccggccacggcggctcttccctgcccgaggcctacagccgctaa

SEQ ID NO: 251 - protein, 408 aa, Chlamydomonas reinhardtii
MQVTMKSSAVSGQRVGGARVATRSVRRAQLQVVASSRKQMGRWRSIDAGVDASDDQQDITRGREMVDDLFQGGFGAGGTHNAVLSSQEYLSQSRASFNNIEDGFYISPAFLDKMTIHIAKNFMDLPKIKVPLILGIWGGKGQGKTFQCALAYKKLGIAPIVMSAGELESGNAGEPAKLIRTRYREASDIIKKGRMCSLFINDLDAGAGRMGDTTQYTVNNQMVNATLMNIADNPTNVQLPGVYKNEEIPRVPIVCTGNDFSTLYAPLIRDGRMEKYYWNPTREDRIGVCMGIFQEDNVQRREVENLVDTFPGQSIDFFGALRARVYDDMVRQWITDTGVDKIGQQLVNARQKVAMPKVSMDLNVLIKYGKSLVDEQENVKRVQLADAYLSGAELAGHGGSSLPEAYSR

SEQ ID NO: 252 - DNA, 1212 bp, Chloroccum littorale
atgcagatgcagatgaagaacaccgccttcaaggccaccggcgccaagactgctcccaaggccgtcagggtgcccgcctgcaaggcttccaagagccaggccggccgctgggcagccatcgacgctggcaatgatatgtccgacgaccagcaagatatcacgcgcgggcgcgacatggttgactctctgttccagggtcctggcagcggtggtggcacccactctgctgtgctgtcctctgaggactacctgtccactgcctcccgcaacttcaacaacgttgaggacggcttctacatctctcctgctttcctggataagatgaccatccatgttgccaagaacttcatggacctgcccaagatcaaggttcccctcatcctgggtatctggggtggcaagggccagggaaagaccttccagtgcgccctggcttacaagaagctgggcatcagccccatcgtcatgtctgccggtgagctggagtctggtaacgccggtgagcccgccaagctcatccgccagcgctaccgcgaggcttccgacagcgtgaagaagggcaagatgtgctccctcttcatcaacgatctggacgctggtgctggccgcatgggcatgggcacccagtacactgtcaacaaccagatggtcaacgctaccctcatgaacatcgctgataaccctaccaacgtgcagctgcccggcgtgtacaaggaggtgcagattccccgtgttcccattgtctgcacgggtaacgatttctccaccctgtacgcccccctcatccgtgacggccgcatggagaagtactactggaaccccacccgtgaggaccgcatcggcgtctgcatgggaatcttccaggaggacaacgtcaaccgtggcgaggtcgaggtgcttgtggatgccttccccgggcagtcgatcgacttcttcggtgccctccgcgcccgcgtctatgatgacaaggtccgtgaattcgtcaagaacactggtgtcgagaacctgtccaagcgcctgattaacagccgcgagggcaaggttgtcttcgagaagccctctatgaacctggatatcctgatgaagtatggaaagttcctgaccaacgagcaggagaatgtcaagcgcgtgcagctcgcagaggagtatatgatgggggcatccctggcaggcgaccacggaacctccctccccgagaactacacccgctaa

SEQ ID NO: 253 - protein, 403 aa, Chloroccum littorale
MQMQMKNTAFKATGAKTAPKAVRVPACKASKSQAGRWAAIDAGNDMSDDQQDITRGRDMVDSLFQGPGSGGGTHSAVLSSEDYLSTASRNFNNVEDGFYISPAFLDKMTIHVAKNFMDLPKIKVPLILGIWGGKGQGKTFQCALAYKKLGISPIVMSAGELESGNAGEPAKLIRQRYREASDSVKKGKMCSLFINDLDAGAGRMGMGTQYTVNNQMVNATLMNIADNPTNVQLPGVYKEVQIPRVPIVCTGNDFSTLYAPLIRDGRMEKYYWNPTREDRIGVCMGIFQEDNVNRGEVEVLVDAFPGQSIDFFGALRARVYDDKVREFVKNTGVENLSKRLINSREGKVVFEKPSMNLDILMKYGKFLTNEQENVKRVQLAEEYMMGASLAGDHGTSLPENYTR

SEQ ID NO: 254 - DNA, 1224 bp, Ostreococcus tauri
atgcgacaggctaatgcgacgacgaagcgcgccgtcgcgccgaagactttcttgggcgcgcgcgtgtcctccgtctccaacggctccaaggttgagatgagccgctggaagggcatggacatggacatctccgacgaccaacaagacatcgcgcgcggtaagaacatggttgactccaagttccaaggtggtgccggtatcggtggtacccacaacgccgttatgtcttcccaagactacttgtccgcgggcatgaagacgtacgacggtcacgacaacatcaccgccgaaaacttctacatctccaagtcttacatggataaggtcgtcgtgcacatcgcgaagaacttcatgcaactcccgaagatcaaggtcccgctcatcctcggtgtgtggggtggtaagggtcaaggtaagactttccagtccgacttgatcttccgcaagctcggtatcaacccgattgtgatgtccgctggtgagctcgaatccggcaacgccggtgagcccgccaagctcgttcgtcaacgttaccgcgaggcgtccgacatcgtcaagaagggccgtatgtccacgctcttcatcaacgatctcgatgccggtgccggtcgtatgggcggcacgacgcagtacaccgtgaacaaccaaatggtgaacgcgacgctcatgaacatcgccgacaaccctaccaacgtccagttgccgggccaatacgaagtcatcgagatcccgcgtgtgccgatcatcgccaccggtaacgatttctccaccctttacgcgccgctcgttcgtgacggccgtatggacaagttctactggtccccgacctttgaagatcgcgtcggcattgccaacggtatcttcatggctgacggcgtctccccggaagacgtcgaagtccttgtctccaccttcgaaggccagtccattgacttcttcggtgccctccgtgcccgcgtgtacgacgacaaggtccgtgacttcatcctctctgttggctatgatcaactcggcaagcgcctcatcaacccgcgcaagggtgaagaagttgtcttcgaaccgccggccatgaccctcgaagtcctcttggcctacggtaaggagatcgaaaacgagcaagaaaacatcaagcgcatccaattggccgatgcctacttggacggtgctgtgttggcgggctctggcggttcctcgaacactgacaagtctctcaacacgaagtaa

SEQ ID NO: 255 - protein, 407 aa, Ostreococcus tauri
MRQANATTKRAVAPKTFLGARVSSVSNGSKVEMSRWKGMDMDISDDQQDIARGKNMVDSKFQGGAGIGGTHNAVMSSQDYLSAGMKTYDGHDNITAENFYISKSYMDKVVVHIAKNFMQLPKIKVPLILGVWGGKGQGKTFQSDLIFRKLGINPIVMSAGELESGNAGEPAKLVRQRYREASDIVKKGRMSTLFINDLDAGAGRMGGTTQYTVNNQMVNATLMNIADNPTNVQLPGQYEVIEIPRVPIIATGNDFSTLYAPLVRDGRMDKFYWSPTFEDRVGIANGIFMADGVSPEDVEVLVSTFEGQSIDFFGALRARVYDDKVRDFILSVGYDQLGKRLINPRKGEEVVFEPPAMTLEVLLAYGKEIENEQENIKRIQLADAYLDGAVLAGSGGSSNTDKSLNTK

SEQ ID NO: 256 - DNA, 1341 bp, Arabidopsis thaliana
atggccgccgcagtttccaccgtcggtgccatcaacagagctccgttgagcttgaacgggtcaggatcaggagctgtatcagccccagcttcaaccttcttgggaaagaaagttgtaactgtgtcgagattcgcacagagcaacaagaagagcaacggatcattcaaggtgttggctgtgaaagaagacaaacaaaccgatggagacagatggagaggtcttgcctacgacacttctgatgatcaacaagacatcaccagaggcaagggtatggttgactctgtcttccaagctcctatgggaaccggaactcaccacgctgtccttagctcatacgaatacgttagccaaggccttaggcagtacaacttggacaacatgatggatgggttttacattgctcctgctttcatggacaagcttgttgttcacatcaccaagaacttcttgactctgcctaacatcaaggttccacttattttgggtatatggggaggcaaaggtcaaggtaaatccttccagtgtgagcttgtcatggccaagatgggtatcaacccaatcatgatgagtgctggagagcttgagagtggaaacgcaggagaacccgcaaagcttatccgtcagaggtaccgtgaggcagctgacttgatcaagaagggaaagatgtgttgtctcttcatcaacgatcttgacgctggtgcgggtcgtatgggtggtactactcagtacactgtcaacaaccagatggttaacgcaacactcatgaacattgctgataacccaaccaacgtccagctcccaggaatgtacaacaaggaagagaacgcacgtgtccccatcatttgcactggtaacgatttctccaccctatacgctcctctcatccgtgatggacgtatggagaagttctactgggccccgacccgtgaagaccgtatcggtgtctgcaagggtatcttcagaactgacaagatcaaggacgaagacattgtcacacttgttgatcagttccctggtcaatctatcgatttcttcggtgctttgagggcgagagtgtacgatgatgaagtgaggaagttcgttgagagccttggagttgagaagatcggaaagaggctggttaactcaagggaaggacctcccgtgttcgagcaacccgagatgacttatgagaagcttatggaatacggaaacatgcttgtgatggaacaagagaatgtcaagagagtccaacttgccgagacctacctcagccaggctgctttgggagacgcaaacgctgacgccatcggccgcggaactttctacggtaaaacagaggaaaaggagcccagcaagtaa

SEQ ID NO: 257 - protein, 446 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKTEEKEPSK

SEQ ID NO: 258 - DNA, 1422 bp, Arabidopsis thaliana
atggccgccgcagtttccaccgtcggtgccatcaacagagctccgttgagcttgaacgggtcaggatcaggagctgtatcagccccagcttcaaccttcttgggaaagaaagttgtaactgtgtcgagattcgcacagagcaacaagaagagcaacggatcattcaaggtgttggctgtgaaagaagacaaacaaaccgatggagacagatggagaggtcttgcctacgacacttctgatgatcaacaagacatcaccagaggcaagggtatggttgactctgtcttccaagctcctatgggaaccggaactcaccacgctgtccttagctcatacgaatacgttagccaaggccttaggcagtacaacttggacaacatgatggatgggttttacattgctcctgctttcatggacaagcttgttgttcacatcaccaagaacttcttgactctgcctaacatcaaggttccacttattttgggctctcggggaggcaaaggtcaaggtaaatccttccagtgtgagcttgtcatggccaagatgggtatcaacccaatcatgatgagtgctggagagcttgagagtggaaacgcaggagaagtccgcaagcttatccgtcagaggtaccgtgaggcagctgacttgatcaagaagggaaagatgtgttgtctcttcatcaacgatcttgacgctggtgcgggtcgtatgggtggtactactcagtacactgtcaacaaccagatggttaacgcaacactcatgaacattgctgataacccaaccaacgtccagctcccaggaatgtacaacaaggaagagaacgcacgtgtccccatcatttgcactggtaacgatttctccaccttatacggtcctctcatccttgatggacgtatggagaagttcttgactggcccgacccgtgaagaccgtatcggtgtctggggtatcttcagaactgacaagatcaaggacgaagacattgtcacacttgttgatcagttccctggtcaatctatcgatttcttcggtgctttgagggcgagagtgtacgatgatgaagtgaggaagttcgttgagagccttggagttgagaagatcggaaagaggctcgttaactcaagggaaggacctcccgtgttcgagcaacccgagatgacttatgagaagcttatggaatacggaaacatgcttgtgatggaacaagagaatgtcaagagagtccaacttgccgagacctacctcagccaggctgctttgggagacgcaaacgctgacgccatcggccgcggaactttctacggaaaaggagcccacgaagtaaacctgccagttcctgaagggtgtactgatcctgtggctgaaaactttgatccaacggctagaagtgacgatggaacctgtgtctacaacttttga

SEQ ID NO: 259 - protein, 473 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGSRGGKGQGKSFQCELVMAKMGINPIMMSAGELESGNAGEVRKLIRQRYREAADLIKKGKMCCLFINDLDAGAGRMGGTTQYTVNNQMVNATLMNIADNPTNVQLPGMYNKEENARVPIICTGNDFSTLYGPLILDGRMEKFLTGPTREDRIGVWGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKGAHEVNLPVPEGCTDPVAENFDPTARSDDGTCVYNF

SEQ ID NO: 260 - DNA, 1314 bp, Acer rubrum
atggctgctgctgtctcgactgttggtgctatcaacagtgcaccgctgagcttgaatggctctggtgctgctggatccactgtcccaacctcagctttcttcggcacaagcttgaagaaggtggcctcaagattccccaacccgaaggtccactccgggagcttcaaagttgtagcagaaatagacgagaataagcagaccgaaaaggataaatggagaggccttgcttatgacacatccgatgaccaacaagacatcaccagaggaaagggtttggtggactctctcttccaggcccccagcgggaccggaactcactacgctgtcatgagctcttacgactacatcagcactggtcttcgaacttacttggaaaacagcatggatggattttacattgctcccgctttcatggacaagcttgttgttcacatcaccaagaacttcatgtctctgcctaacatcaagattcctttgatcttgggtatttggggaggcaaaggtcagggaaaatcattccaatgtgagcttgttttcgcaaagatgggtattacccctattatgatgagtgccggagaactggaaagtggaaacgcgggagaacccgcgaagcttatcaggcaaagatatcgtgaggcagctgatataatcaagaagggaaagatgtgctgcctcttcatcaatgatcttgatgccggagctggacgtatgggcggaaccactcaatacacagttaacaaccagatggttaatgctactctcatgaacattgctgataatccaaccagtgtccagctccctggaatgtacaacaaggaggaaaacccccgtgtcccaatcattgtcactggtaacgacttttcaaccttgtatgctcctcttatccgtgatggtcgtatggagaaattctactgggctcctaccagggaagaccgcattggtgtctgcaaaggaattttcaggagtgacaatgttgctgatggtgaactaatcaagcttgtcgacaccttccctggccaatcaatcgactttttcggtgccctgagggccagagtgtacgacgatgaagtgaggaagtggatctctggcataggcgttgatagcattgggaagaaccttgtgaactcaaagaacggacccccaaccttcgagcaacccaaaatgacaatcgacaagctccttgagtacggaaacatgcttgtccaggagcaagagaacgtcaagagagtccaattagccgacaagtacctgagcgaggctgcccttggcgatgctaacgatgatgctatcaagcgtggatctttctacggttag

SEQ ID NO: 261 - protein, 437 aa, Acer rubrum
MAAAVSTVGAINSAPLSLNGSGAAGSTVPTSAFFGTSLKKVASRFPNPKVHSGSFKVVAEIDENKQTEKDKWRGLAYDTSDDQQDITRGKGLVDSLFQAPSGTGTHYAVMSSYDYISTGLRTYLENSMDGFYIAPAFMDKLVVHITKNFMSLPNIKIPLILGIWGGKGQGKSFQCELVFAKMGITPIMMSAGELESGNAGEPAKLIRQRYREAADIIKKGKMCCLFINDLDAGAGRMGGTTQYTVNNQMVNATLMNIADNPTSVQLPGMYNKEENPRVPIIVTGNDFSTLYAPLIRDGRMEKFYWAPTREDRIGVCKGIFRSDNVADGELIKLVDTFPGQSIDFFGALRARVYDDEVRKWISGIGVDSIGKNLVNSKNGPPTFEQPKMTIDKLLEYGNMLVQEQENVKRVQLADKYLSEAALGDANDDAIKRGSFYG

SEQ ID NO: 262 - DNA, 1425 bp, Acer rubrum
atggctgctgctgtctcgactgttggtgctatcaacagtgcaccgctgagcttgaatggctctggtgctgctggatccactgtcccaacctcagctttcttcggcacaagcttgaagaaggtggcctcaagattccccaacccgaaggtccactccgggagcttcaaagttgtagcagaaatagacgagaataagcagaccgaaaaggataaatggagaggccttgcttatgacacatccgatgaccaacaagacatcaccagaggaaagggtttggtggactctctcttccaggcccccagcgggaccggaactcactacgctgtcatgagctcttacgactacatcagcactggtcttcgaacttacttggaaaacagcatggatggattttacattgctcccgctttcatggacaagcttgttgttcacatcaccaagaacttcatgtctctgcctaacatcaagattcctttgatcttgggtatttggggaggcaaaggtcagggaaaatcattccaatgtgagcttgttttcgcaaagatgggtattacccctattatgatgagtgccggagaactggaaagtggaaacgcgggagaacccgcgaagcttatcaggcaaagatatcgtgaggcagctgatataatcaagaagggaaagatgtgctgcctcttcatcaatgatcttgatgccggagctggacgtatgggcggaaccactcaatacacagttaacaaccagatggttaatgctactctcatgaacattgctgataatccaaccagtgtccagctccctggaatgtacaacaaggaggaaaacccccgtgtcccaatcattgtcactggtaacgacttttcaaccttgtatgctcctcttatccgtgatggtcgtatggagaaattctactgggctcctaccagggaagaccgcattggtgtctgcaaaggaattttcaggagtgacaatgttgctgatggtgaactaatcaagcttgtcgacaccttccctggccaatcaatcgactttttcggtgccctgagggccagagtgtacgacgatgaagtgaggaagtggatctctggcataggcgttgatagcattgggaagaaccttgtgaactcaaagaacggacccccaaccttcgagcaacccaaaatgacaatcgacaagctccttgagtacggaaacatgcttgtccaggagcaagagaacgtcaagagagtccaattagccgacaagtacctgagcgaggctgcccttggcgatgctaacgatgatgctatcaagcgtggatctttctacggcaaagcagctcagcaagtgaatgttcctgtccctgaaggttgtactgatcgaaatgcagcaaactatgatccaacggcaaggagtgatgacggaagctgccagtatacactctag

SEQ ID NO: 263 - protein, 474 aa, Acer rubrum
MAAAVSTVGAINSAPLSLNGSGAAGSTVPTSAFFGTSLKKVASRFPNPKVHSGSFKVVAEIDENKQTEKDKWRGLAYDTSDDQQDITRGKGLVDSLFQAPSGTGTHYAVMSSYDYISTGLRTYLENSMDGFYIAPAFMDKLVVHITKNFMSLPNIKIPLILGIWGGKGQGKSFQCELVFAKMGITPIMMSAGELESGNAGEPAKLIRQRYREAADIIKKGKMCCLFINDLDAGAGRMGGTTQYTVNNQMVNATLMNIADNPTSVQLPGMYNKEENPRVPIIVTGNDFSTLYAPLIRDGRMEKFYWAPTREDRIGVCKGIFRSDNVADGELIKLVDTFPGQSIDFFGALRARVYDDEVRKWISGIGVDSIGKNLVNSKNGPPTFEQPKMTIDKLLEYGNMLVQEQENVKRVQLADKYLSEAALGDANDDAIKRGSFYGKAAQQVNVPVPEGCTDRNAANYDPTARSDDGSCQYTL

SEQ ID NO: 264 - DNA, 1317 bp, Chenopodium quinoa
atggctactgctgtctcaaccgtcggagctgctaccaaggcacctttgaacttgaatggctcgagcgctggggcatcagtcccaacctcagctttcttagggagcagcttaaagaagcatacaagtgtgagattcccaagcagctctagggcgagctcaatgaccgtcaaggcggctgactacgaggagagcaagcagtccaacacggacagatgggctcatttggctacagacatctctgatgatcaactcgacatccgtaggggtaagggtatggttgactccctcttccaagctccgatggactccggcacccacgttccagttcagagttcactcgaatacgagagtcaaggtcttaggaagtacaacatcgacaacatgttgggtaacttctacattgccccttctttcatggacaagattgttgttcacatcaccaagaactacttgaacttgcctaacatcaaggttcccctgatcttgggtatttggggaggcaaaggtcaaggtaaatccttccaatgtgagcttgtgttcgccaagatgggaatcaaccccatcatgatgagtgcgggagaattggaaagtggaaacgcaggagagccagcaaagttgatcaggcaaaggtaccgtgaggcagcagacataattgccaagggaaagatgtgtgctctgttcatcaacgatctcgacgcgggtgctggacgtatgggaggcaccacacaatacaccgtgaacaaccagatggttaacgccaccctcatgaacattgctgacaaccccaccaatgtccaactccctggtatgtacaacaagcaagagaacgcccgtgttcccattatcgtcactggtaacgacttctccaccttgtacgctccccttatccgtgatggtcgtatggagaagttctactgggctcccacccgtgaggaccgtatcggtgttgccaccggtatcttcaggaccgacaatgttcctgaggaccacgttgtcaagctcgtcgacaccttccctggccaatctattgatttcttcggtgccttgagggctcgtgtatacgatgatgaagtaaggaagtgggtttctgaagtaggaattgacgccgtaggaaagaagctcgtaaactcaagggacggaccaccagtgttcgaacaaccaaaaatgaccttggaaaagttgcttgaatacggaaacatgcttgtgcaagagcaagagaatgtcaagagagtccaacttgctgacaagtacttgagcgaggctgctcttggagatgctaacaaagatgctattgcatccggagctttcttcggttaa

SEQ ID NO: 265 - protein, 438 aa, Chenopodium quinoa
MATAVSTVGAATKAPLNLNGSSAGASVPTSAFLGSSLKKHTSVRFPSSSRASSMTVKAADYEESKQSNTDRWAHLATDISDDQLDIRRGKGMVDSLFQAPMDSGTHVPVQSSLEYESQGLRKYNIDNMLGNFYIAPSFMDKIVVHITKNYLNLPNIKVPLILGIWGGKGQGKSFQCELVFAKMGINPIMMSAGELESGNAGEPAKLIRQRYREAADIIAKGKMCALFINDLDAGAGRMGGTTQYTVNNQMVNATLMNIADNPTNVQLPGMYNKQENARVPIIVTGNDFSTLYAPLIRDGRMEKFYWAPTREDRIGVATGIFRTDNVPEDHVVKLVDTFPGQSIDFFGALRARVYDDEVRKWVSEVGIDAVGKKLVNSRDGPPVFEQPKMTLEKLLEYGNMLVQEQENVKRVQLADKYLSEAALGDANKDAIASGAFFG

SEQ ID NO: 266 - DNA, 1287 bp, Deschampsia antartica
  misc_feature (48)..(48): n is a, c, g, or t
  misc_feature (282)..(282): n is a, c, g, or t
  misc_feature (306)..(306): n is a, c, g, or t
  misc_feature (981)..(981): n is a, c, g, or t
atggctgctgccttctcctccaccgtcggagctccggcttccacgccnaccagcttcctcggcaacaagctcaagaagcaggtgacctcggcagtgaactaccatggcaagagcttcaaggccaacaggttcaccgtcatggccaaggatatcgacgagggcaagcagaccgacggggacaagtggaagggcctcgcctacgatatctccgacgaccagcaggacatcaccaggggtaagggtatcgtcgactccttgttccaggcgcccatgggcgatggnacccacgaggccgtcctcagctcntacgagtacgtcagccagggcctcaagaagtacgacttcgacaacaccatgggaggcttctacatcgccccggctttcatggacaagctcgttgtccacctctccaagaacttcatgaccctgcccaacatcaagatcccactcatcttgggtatctggggaggaaagggtcaggggaaatccttccagtgtgagcttgtcttcgccaagatgggcatcaacccaatcatgatgagtgccggagagctggagagcggcaacgccggagagccagccaagctcatcaggcagcggtaccgcgaggccgcagacatgatcaagaagggcaagatgtgctgcctcttcatcaacgacctcgacgccggcgcgggtcggatgggcgggaccacccagtacaccgtgaacaaccagatggtgaacgccaccctgatgaacatcgccgacgcgcccaccaacgtgcagctcccggggatgtacaacaaggaggagaacccccgtgtccccatcatcgtcaccggcaacgacttctcgacgctgtacgcgcccctcatccgtgacggtcgtatggagaagttctactgggcgcccacccgcgaggaccgtatcggcgtctgcaagggtatcttccagaccgacaacgtcagcgacgagtctgtcgtcaagatcgtcgacacnttcccaggacagtccatcgacttcttcggtgctctgcgtgctcgggtgtacgacgttgaggtgcgcaagtgggtgtcgtccaccggaattgagaacatcggcaagaggctggtgaactcgcgggacggacccgtcaccttcgagcagcccaagatgacggtggagaagttgctggagtacggccacatgcttgtccaggagcaggacaatgtcaagcgtgtgcagcttgcggacacttacatgagccaggcagctctgggtgatgcgaacaaggatgccatgaagactggttccttctacggttag

SEQ ID NO: 267 - protein, 428 aa, Deschampsia antartica
MAAAFSSTVGAPASTPTSFLGNKLKKQVTSAVNYHGKSFKANRFTVMAKDIDEGKQTDGDKWKGLAYDISDDQQDITRGKGIVDSLFQAPMGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDLDAGAGRMGGTTQYTVNNQMVNATLMNIADAPTNVQLPGMYNKEENPRVPIIVTGNDFSTLYAPLIRDGRMEKFYWAPTREDRIGVCKGIFQTDNVSDESVVKIVDTFPGQSIDFFGALRARVYDVEVRKWVSSTGIENIGKRLVNSRDGPVTFEQPKMTVEKLLEYGHMLVQEQDNVKRVQLADTYMSQAALGDANKDAMKTGSFYG

SEQ ID NO: 268 - DNA, 1398 bp, Deschampsia antartica
  misc_feature (816)..(816): n is a, c, g, or t
atggctgctgccttctcctccaccgtcggagctccggcttccacgccgaccagcttcctcggcaacaagctcaagaagcaggtgacctcggcagtgaactaccatggcaagagcttcaaggccaacaggttcaccgtcatggccaaggatatcgacgagggcaagcagaccgacggggacaagtggaagggcctcgcctacgatatctccgacgaccagcaggacatcaccaggggtaagggtatcgtcgactccctgttccaggcgcccatgggcgatggcacccacgaggccgtcctcagctcctacgagtacgtcagccagggcctcaagaagtacgacttcgacaacaccatgggaggcttctacatcgccccggctttcatggacaagctcgttgtccacctctccaagaacttcatgaccctgcccaacatcaagatcccactcatcttgggtatctggggaggaaagggtcaggggaaatccttccagtgtgagcttgtcttcgccaagatgggcatcaacccaatcatgatgagtgccggagagctggagagcggcaacgccggagagccagccaagctcatcaggcagcggtaccgcgaggccgcagacatgatcaagaagggcaagatgtgctgcctcttcatcaacgacctcgacgccggcgcgggtcggatgggcgggaccacccagtacaccgtgaacaaccagatggtgaacgccaccctgatgaacatcgccgacgcgcccaccaacgtgcagcttccggggatgtacaacaaggaggagaacccccgtgttcccattatngtcaccggcaacgacttttcgacgctgtacgccccccttattcctgacggtcgtatggagaagttttactgggcgcccacccgcgaggaccgtatcggcgtctgcaagggtatcttccagaccgacaacgtcagcgacgagtctgtcgtcaagatcgtcgacaccttcccaggacagtccatcgacttcttcggtgctctgcgtgctcgggtgtacgacgacgaggtgcgcaagtgggtgtcgtccaccggaattgagaacatcggcaagaggctggtgaactcgcgggacggacccgtcaccttcgagcagcccaagatgacggtggagaagttgctggagtacggccacatgcttgtccaggagcaggacaatgtcaagcgtgtgcagcttgcggacacttacatgagccaggcagctctgggtgatgcgaacaaggatgccatgaagactggttccttctacggtaaaggagcacaacaaggcactttgcctgtgccggaaggttgtaccgaccgggatgccaagaacttcgacccaaccgcgaggagcgacgacggcagctgcctttacaccttttaa

SEQ ID NO: 269 - protein, 465 aa, Deschampsia antartica
  misc_feature (272)..(272): Xaa can be any naturally occurring amino acid
MAAAFSSTVGAPASTPTSFLGNKLKKQVTSAVNYHGKSFKANRFTVMAKDIDEGKQTDGDKWKGLAYDISDDQQDITRGKGIVDSLFQAPMGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDLDAGAGRMGGTTQYTVNNQMVNATLMNIADAPTNVQLPGMYNKEENPRVPIXVTGNDFSTLYAPLIPDGRMEKFYWAPTREDRIGVCKGIFQTDNVSDESVVKIVDTFPGQSIDFFGALRARVYDDEVRKWVSSTGIENIGKRLVNSRDGPVTFEQPKMTVEKLLEYGHMLVQEQDNVKRVQLADTYMSQAALGDANKDAMKTGSFYGKGAQQGTLPVPEGCTDRDAKNFDPTARSDDGSCLYTF

SEQ ID NO: 270 - DNA, 1440 bp, Glycine max
atggctgcctccgtctccactgtcggagctgtcaacagagctcttttgaacctgaatggttctggagctggagcttcagctcccagttcagccttctttgggaccagcttgaagaaggttattgcctcaagggtccccaacagcaaggtttccggtggaagcttcaagattgttgctgtagaagagaagaaagagattgaagagacccagcagaccgacaaggacagatggaagggtcttgcctatgatatctcagacgaccaacaagacatcacaagaggaaagggtttggttgactcccttttccaagctccacaggatgctggaactcactatgcagtcatgagctcctacgagtaccttagcactggacttcgccagtacttggacaacaacatggatggattttacattgctccagcttttatggacaagcttgttgttcacatcagcaagaacttcatgaccctgcccaacatcaaggttcctctcattcttggtatctggggaggcaaaggtcaaggaaaatctttccaatgcgagcttgtctttgccaagatgggaatcaaccccatcatgatgagtgctggagagttggaaagtggaaatgcaggagagccagcaaaactgatcagacagagataccgtgaagccgcagacatgatcaagaagggaaagatgtgtgctctcttcatcaacgatcttgatgcaggagctggtcgtcttggtggaactacacaatacactgtcaacaaccagatggtgaatgccaccctcatgaacattgctgataaccccaccaatgtgcagcttcctggtatgtacaacaaggaagagaacccccgtgtgcccatcatcgtcaccggtaacgatttctcaacactgtatgctcctctcatccgtgatgggcgtatggagaagttctactgggcacctacaagggacgatcgtgttggcgtctgcaatggaattttccgcactgacaatgttcctaaggatgacattgtcaagcttgttgacaccttccccggccaatctattgatttctttggtgcactcagggctagagtatatgatgatgaggtgaggaagtggatttctgttgttggtgttgacttcattgggaagaagcttgtgaactccaaggaaggacctccaacctttgaccaaccgaagatgactttgagcaagctcttggagtatggtaacatgcttgtccaagaacaagagaatgtgaagagagtacaactggcagacaagtacttgaaagaggctgctcttggtgatgctaatcaagatgccatcaaaagaggaactttctatggcaaagcagcccagcaagtaaaaattcccgttcctgaaggttgtactgatccaaatgcctcaaacttcgacccaactgcaagaagtgatgatggaacctgcttatacacaccctga

SEQ ID NO: 271 - protein, 479 aa, Glycine max
MAASVSTVGAVNRALLNLNGSGAGASAPSSAFFGTSLKKVIASRVPNSKVSGGSFKIVAVEEKKEIEETQQTDKDRWKGLAYDISDDQQDITRGKGLVDSLFQAPQDAGTHYAVMSSYEYLSTGLRQYLDNNMDGFYIAPAFMDKLVVHISKNFMTLPNIKVPLILGIWGGKGQGKSFQCELVFAKMGINPIMMSAGELESGNAGEPAKLIRQRYREAADMIKKGKMCALFINDLDAGAGRLGGTTQYTVNNQMVNATLMNIADNPTNVQLPGMYNKEENPRVPIIVTGNDFSTLYAPLIRDGRMEKFYWAPTRDDRVGVCNGIFRTDNVPKDDIVKLVDTFPGQSIDFFGALRARVYDDEVRKWISVVGVDFIGKKLVNSKEGPPTFDQPKMTLSKLLEYGNMLVQEQENVKRVQLADKYLKEAALGDANQDAIKRGTFYGKAAQQVKIPVPEGCTDPNASNFDPTARSDDGTCLYTP

SEQ ID NO: 272 - DNA, 1317 bp, Gossypium hirsutum
atggcggctgccgtctccaccatcggtgctgtcaaccgagcaccgttgagtttgaatggatcaggtgccggagcttctgctccaagctcagctttcatggggaacagcttgaagaaagtgagcgctaggttcaacaacaacggcaaggctccagtgggaagtttcaagattgtggctgccaaagaaatcgacgaagacacacagaccgaccaggaccgatggaagggtcttgcttatgatatctccgatgaccaacaagacattaccagagggaaaggtatggtcgactcattgttccaagctcccatgaacgatggtactcactatgctgtcatgagctcctatgagtacattagccaaggccttcgcacatacgacttggacaacaacatggatggattctacattgccccagctttcatggacaagcttgttgttcacatcaccaagaactacatgacccttcctaacattaaggttcctcttatcttgggtatttggggaggcaaaggtcaaggaaaatctttccaatgtgagcttgtctttgccaagatgggaatcaaccccattatgatgagtgccggagaattggaaagtgggaacgccggagaaccagccaagttgatcaggcaaaggtaccgtgaggccgccgacattatcaagaaagggaaaatgtgttgcctctttatcaacgatctcgacgctggagccggtcgtatgggaggaaccacacaatacacagtgaacaaccaaatggtgaacgccacactcatgaacatcgctgataaccccaccaacgttcagctccccggtatgtacaacaaggaagagaaccctcgtgttccgatcattgtcaccggtaacgatttctcgacgctgtacgcgccgctcatccgtgacggtcgtatggagaagttttactgggcacccaccagggaagataggatcggtgtttgcacaggtattttcaggaccgacaatgttcccgttgatgacattgttaagcttgttgacaccttcccgggccaatccattgactttttcggtgctctgagggccagagtttacgatgacgaagtgaggaaatggatcggagaggtaggagtcaatagtgtcgggaaaaagctcgtgaactcgagggaagggccaccatctttcgagcaacctacgatgaccattgagaagctgttggagtatggaaacatgcttgttgctgaacaagagaacgtgaagagggttcaattggctgacaaatatttgagtgaagctgcccttggaaatgctaatgacgatgctatcaagagaggagctttctaa

SEQ ID NO: 273 - protein, 438 aa, Gossypium hirsutum
MAAAVSTIGAVNRAPLSLNGSGAGASAPSSAFMGNSLKKVSARFNNNGKAPVGSFKIVAAKEIDEDTQTDQDRWKGLAYDISDDQQDITRGKGMVDSLFQAPMNDGTHYAVMSSYEYISQGLRTYDLDNNMDGFYIAPAFMDKLVVHITKNYMTLPNIKVPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEENPRVPIIVTGNDFSTLYAPLIRDGRMEKFYWAPTREDRIGVCTGIFRTDNVPVDDIVKLVDTFPGQSIDFFGALRARVYDDEVRKWIGEVGVNSVGKKLVNSREGPPSFEQPTMTIEKLLEYGNMLVAEQENVKRVQLADKYLSEAALGNANDDAIKRGAF

SEQ ID NO: 274 - DNA, 1284 bp, Hordeum vulgare
atggctgctgccttctcctccaccgtcggggctccggcttctacgccgaccaacttcctcgggaagaagctcaagaagcaggtgacctcggccgtgaactaccatggcaagagctccaaggccaacaggttcacagtcatggcagcggagaacatcgacgagaagaggaacaccgacaagtggaagggtcttgctaccgatatctccgacgaccagcaggacatcaccagagggaagggcatcgtggactcgctcttccaggcgcccacgggcgacggcacccacgaggccgtcctcagctcctacgagtacgtcagccagggcctgcggaagtacgacttcgacaacaccatgggaggcttctacatcgctcctgctttcatggacaagcttgttgtccatctctccaaaaacttcatgaccctgcccaacatcaagatcccactcatcttgggtatctggggaggcaagggtcaaggaaaatcattccagtgtgagcttgtgttcgccaagatgggcatcaaccccatcatgatgagtgccggagagctggagagtgggaacgctggagagccagccaagctcatcaggcagcggtaccgtgaggctgcagacatgatcaagaagggtaagatgtgctgcctcttcatcaacgatcttgacgctggtgcgggtaggatgggcggaaccacgcagtacaccgtcaacaaccagatggtgaacgccaccctgatgaacatcgccgatgcccccaccaacgtgcagctccctggcatgtacaacaagagggagaacccccgtgtgcccatcgtcgtcaccggtaacgatttctcgacgctctacgctcctctgatccgtgatggtcgtatggagaagttctactgggctcccacccgtgacgaccgtatcggtgtctgcaagggtatcttccagaccgacaatgtctgtgacgagtctgtcgtaaagatcgtcgacaccttcccaggacaatccattgactttttcggtgctctgcgtgctcgggtgtacgacgatgaggtgcgcaagtgggtcggctctaccggaatcgagaacattggcaagaggctggtgaactcgcgggacgggcccgtgaccttcgagcagccaaagatgacagtcgagaagctgctagagtacgggcacatgctcgtccaggagcaggacaatgtcaagcgtgtgcagcttgctgacacctacatgagccaggcagctctgggtgatgctaaccaggatgcgatgaagactggttccttctacggttag

SEQ ID NO: 275 - protein, 427 aa, Hordeum vulgare
MAAAFSSTVGAPASTPTNFLGKKLKKQVTSAVNYHGKSSKANRFTVMAAENIDEKRNTDKWKGLATDISDDQQDITRGKGIVDSLFQAPTGDGTHEAVLSSYEYVSQGLRKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDLDAGAGRMGGTTQYTVNNQMVNATLMNIADAPTNVQLPGMYNKRENPRVPIVVTGNDFSTLYAPLIRDGRMEKFYWAPTRDDRIGVCKGIFQTDNVCDESVVKIVDTFPGQSIDFFGALRARVYDDEVRKWVGSTGIENIGKRLVNSRDGPVTFEQPKMTVEKLLEYGHMLVQEQDNVKRVQLADTYMSQAALGDANQDAMKTGSFYG

SEQ ID NO: 276 - DNA, 1278 bp, Hordeum vulgare
atggcttctgctttctcgtccaccgttggagctccggcgtcgaccccgaccatcttcctgggcaagaaggtgaagaactactaccatggtggcaacaagatgaagagcagggtggtgagggtcatggcggccaaaaaggaacttgaccagggcaagcagaccgatgcggaccggtggaagggtctggcctacgacatctcggacgaccagcaggacatcactcgggggaaaggcatcgtggactccctgttccaggcccccatgggcgacggcacccacgaggccatcctaagctcctacgagtacatcagccagggcctgcggaagtacgacttcgacaacaccatggacgggctgtacatcgcgccggcattcatggacaagctcatcgtccacctcgccaagaacttcatgacactccccaacatcaaggttcctctcatcctgggtatctggggaggcaagggacagggcaagtcgttccagtgtgagctggtgttcgccaagatgggcatcaaccccatcatgatgagcgccggtgagctggagagcggcaacggcgagccggccaagctgatccggcagaggtaccgcgaggcggccgacattatcaacaagggcaagatgtgctgcctcttcatcaacgacctggacgccggcgcgggccggatgggcgggacgacgcagtacacggtgaacaaccagatggtgaacgccaccctgatgaacatcgcggacgcgcccaccaacgtgcagctcccggggatgtacaacaaggaggagaacccccgcgtgcccatcatcgtcaccggcaacgacttctcgacgctgtacgctcccctgatccgtgacgggcgcatggagaagttctactgggcgcccacccgcgaggaccgcatcggcgtgtgcaagggcatcttccgcaccgacaacgtcccggacgaggccgtggtgaggctggtggacaccttcccggggcagtccatcgacttcttcggcgcgctgcgggcacgggtgtacgacgacgaggtgcgcaagtgggtcggcgagatcggcgtggagaacatctccaagcgcctcgtcaactccagggaggggccgcccacgttcgaccagcccaagatgaccatagagaagctcatggagtacggccacatgctggtccaggagcaggagaacgtcaagcgtgtgcagctcgccgacaagtacctcagcgaggcggcgctcggccaagccaacgacgacgccatgaagaccggtgccttctacggcaagtag

SEQ ID NO: 277 - protein, 425 aa, Hordeum vulgare
MASAFSSTVGAPASTPTIFLGKKVKNYYHGGNKMKSRVVRVMAAKKELDQGKQTDADRWKGLAYDISDDQQDITRGKGIVDSLFQAPMGDGTHEAILSSYEYISQGLRKYDFDNTMDGLYIAPAFMDKLIVHLAKNFMTLPNIKVPLILGIWGGKGQGKSFQCELVFAKMGINPIMMSAGELESGNGEPAKLIRQRYREAADIINKGKMCCLFINDLDAGAGRMGGTTQYTVNNQMVNATLMNIADAPTNVQLPGMYNKEENPRVPIIVTGNDFSTLYAPLIRDGRMEKFYWAPTREDRIGVCKGIFRTDNVPDEAVVRLVDTFPGQSIDFFGALRARVYDDEVRKWVGEIGVENISKRLVNSREGPPTFDQPKMTIEKLMEYGHMLVQEQENVKRVQLADKYLSEAALGQANDDAMKTGAFYGK

SEQ ID NO: 278 - DNA, 1308 bp, Larrea tridentata
  misc_feature (60)..(60): n is a, c, g, or t
  misc_feature (1110)..(1110): n is a, c, g, or t
atggctgctgcctactccaccgtcggagctgtcaacagggcaccgctgagcttgaatggntctggtgcgagagcttcattggttccaagcactgccttcttcggcagcagcttgaagaaatctgctgcgaaattccccaaggcgtcatcaggaaacttcaagattgttgcacaagaaattagtgaggatcagcagaccgacaaggacaaatggaagggtcttgcctatgacatttctgatgatcaacaggatatcactagaggaaagggtatggttgatactctcttccaagctcccatgcaatctggcactcactatgctgtcatgagttcttacgactacatcagtcaaggacttcgccagtacaacttggacaacaacatggacggtttctacatagcaccagccttcatggacaagcttgtcgtccacatcaccaagaacttcttgagtctccctaacatcaagattcctctgatcttgggtatctggggaggcaaaggtcaaggaaaatctttccaatgtgaacttgtttttgccaagatgggaatcaaccccatcatgatgagtgctggagagctggaaagtggaaatgcaggagaacctgccaagctgatcaggcaaaggtaccgtgaagctgctgacattatcaagaagggtaaaatgtgctgcctgttcatcaacgatctcgacgctggagctggtcgtatgggtggaacaactcaatacactgttaacaaccagatggtgaatgccaccctcatgaacattgctgacaacccaacaaatgtccagctccctggtatgtacaacaaggaagagaaccctcgtgtgcctatcattgtcactggtaacgacttctcgacattgtacgctcctcttatccgtgatggtcgtatggaaaaattctactgggctcctaccagggaagaccgtattggtgtctgcaagggtattttcaggactgacaatgttcctgaagaagacattgtcaaggttgtagaccaattccctggtcaatctattgatttctttggagccctgagggcaagagtgtacgatgatgaagtgaggaagtgggtttccgaagtcggtgtcgacaccatcggnaagaagctggtgaactcaaaggaaggacccccaacatttgagcagcccaagatgaccattgataagctcctgcaatatggaaacatgcttgtggaagagcaagaaaatgtgaagagagtccaattggctgacaagtacatgagtgaggctgcccttggtgatgctaaccaggatgctattaagaggggaactttctaa

SEQ ID NO: 279 - protein, 435 aa, Larrea tridentata
MAAAYSTVGAVNRAPLSLNGSGARASLVPSTAFFGSSLKKSAAKFPKASSGNFKIVAQEISEDQQTDKDKWKGLAYDISDDQQDITRGKGMVDTLFQAPMQSGTHYAVMSSYDYISQGLRQYNLDNNMDGFYIAPAFMDKLVVHITKNFLSLPNIKIPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEENPRVPIIVTGNDFSTLYAPLIRDGRMEKFYWAPTREDRIGVCKGIFRTDNVPEEDIVKVVDQFPGQSIDFFGALRARVYDDEVRKWVSEVGVDTIGKKLVNSKEGPPTFEQPKMTIDKLLQYGNMLVEEQENVKRVQLADKYMSEAALGDANQDAIKRGTF

SEQ ID NO: 280 - DNA, 1380 bp, Lycopersicon pennellii
atggctgcctcagtgtcaaccattggagctgccagcaaagcaccattgagtttgaacaactcagttgctggaacttccgttccaagcacagccttctttggaaaatccttgaaaaaagtgtatgcaaaaggtgtttccagccccaaggtttcaaacaggaacttgagggttgtagctcaagaagtagacgaaacgaaagaggacagatggaagggtctttatgataacacatcggatgaccaacaggacattgcaaggggtaagggtctggtcgacagtcttttccaggctcctaccggtactggtactcaccacgccatcatgaattcctacgaatacgtcagccaggctcttaaaacgtaccaattggacaacaaattggacggcttctacattgcccctgctttcatggacaaacttgttgttcacatcaccaagaacttcttgacattgcccaacatcaaggttccactcatcttgggtgtatggggaggcaaaggtcaaggtaaatcattccaatgtgagcttgtcttcagaaagatgggaatcaaccccattatgatgagtgctggagaattggaaagtggaaatgcaggagagccagctaaattgattaggcaaaggtacagagaggcagctgaaatcatcaggaaaggaaacatgtgttgtctcttcatcaacgatctcgatgcaggagctggtagaatgggtggaactacccaatacaccgtcaacaaccagatggtgaatgccaccctcatgaacattgctgacaacccaacaaatgtccagctccccggtatgtacaacaagcaagagaacgccagggtacccattattgtcactggtaacgacttctccacattgtatgctcctcttatccgtgatggtcgtatggagaagttctactgggcaccaactagggaggatagaattggtgtttgcaagggtattttcagaactgacaacgtccctgaggaagctgttgtaaagattgtcgattccttccctggacaatctattgatttctttggtgctttgagggcccgagtatatgacgatgaagtgaggaaatgggtttcaggaactggaattgaactcattggtgaaaaacttttgaactctagagatggacccccaacttttgagcaaccaaaaatgacccttgagaagctccttgagtatggtaacatgcttgttcaagagcaagagaatgtcaagagagtccagttggctgaaacctatcttaaagaggcagctctcggagatgctaacgctgatgccatcaacactggaatttctaagaacttcaccaatctcaaaagtcgtctaaacaatgaagaggcgaaaaaagcgcgacatgtcaacttccaggagtga

SEQ ID NO: 281 - protein, 459 aa, Lycopersicon pennellii
MAASVSTIGAASKAPLSLNNSVAGTSVPSTAFFGKSLKKVYAKGVSSPKVSNRNLRVVAQEVDETKEDRWKGLYDNTSDDQQDIARGKGLVDSLFQAPTGTGTHHAIMNSYEYVSQALKTYQLDNKLDGFYIAPAFMDKLVVHITKNFLTLPNIKVPLILGVWGGKGQGKSFQCELVFRKMGINPIMMSAGELESGNAGEPAKLIRQRYREAAEIIRKGNMCCLFINDLDAGAGRMGGTTQYTVNNQMVNATLMNIADNPTNVQLPGMYNKQENARVPIIVTGNDFSTLYAPLIRDGRMEKFYWAPTREDRIGVCKGIFRTDNVPEEAVVKIVDSFPGQSIDFFGALRARVYDDEVRKWVSGTGIELIGEKLLNSRDGPPTFEQPKMTLEKLLEYGNMLVQEQENVKRVQLAETYLKEAALGDANADAINTGISKNFTNLKSRLNNEEAKKARHVNFQE

SEQ ID NO: 282 - DNA, 1314 bp, Malus domestica
atggccactgctgtctctaccattggatctgtcaacagagcaccgccgaacctgaatggctctagcagcagtgcttcagttccaagctcaacctttttgggaagcagcttgaagaaagtgaactcaaggttcacgaactccaaggtttcctccgggagtctcaggattgtcgcgagtgtggacgaagataagcagaccgacaaggacagatggaaaggccttgccttcgacacctccgacgaccaacaagacatcacaagaggaaagggtaaggtggactccctcttccaggcacctcaaggatcaggaactcactttgccatcatgagctcttatgaatacatcagcacgggccttcgccagtacaactttgacaataacatggacggttattatattgctcccgcttttatggacaagcttgttgttcacatcaccaagaacttcatgacccttcctaacatgaaggttcctctcatcttgggtatttggggaggcaaaggtcagggcaagtctttccagtgcgagcttgtctttgccaagatgagaatcagccctatcatgatgagtgccggagaattggaaagtggaaacgcaggagaacccgcgaagctgatcaggcaaaggtaccgtgaagcagccgacattatcaggaagggtaaaatgtgtgcactcttcatcaacgatcttgatgcaggagctggtcggcttggtggaaccacccaatacactgtcaacaaccaaatggtgaatgccaccctcatgaacattgctgataacccgacaaacgtccagcttccaggtatgtacaacaaggaggagaacccccgtgtcccaatcattgtcaccggtaacgatttctcaacattgtacgctcctctcatccgtgacggtcgtatggagaagttctactgggctcccacccgcgaagatcgtattggagtctgcattgggatcttcaggagtgacaatgttgctaaggaagacattgtcaagcttgttgacaccttcccaggccaatctattgatttctttggtgccttgagggctagggtttacgacgatgaagtgaggaagtggattacgggtgttggcgtggatagcattgggaagaagcttgtgaactcaaaggaaggacccccaactttcgagcagccgaagatgactatcgaaaagctcctcgagtacggaaacatgcttgtccaagagcaagagaatgtgaagagagttcaattggctgataagtacttgagcgaggctgctcttggtgatgctaactcagatgctatgaatacaggaactttctatggttag

SEQ ID NO: 283 - protein, 437 aa, Malus domestica
MATAVSTIGSVNRAPPNLNGSSSSASVPSSTFLGSSLKKVNSRFTNSKVSSGSLRIVASVDEDKQTDKDRWKGLAFDTSDDQQDITRGKGKVDSLFQAPQGSGTHFAIMSSYEYISTGLRQYNFDNNMDGYYIAPAFMDKLVVHITKNFMTLPNMKVPLILGIWGGKGQGKSFQCELVFAKMRISPIMMSAGELESGNAGEPAKLIRQRYREAADIIRKGKMCALFINDLDAGAGRLGGTTQYTVNNQMVNATLMNIADNPTNVQLPGMYNKEENPRVPIIVTGNDFSTLYAPLIRDGRMEKFYWAPTREDRIGVCIGIFRSDNVAKEDIVKLVDTFPGQSIDFFGALRARVYDDEVRKWITGVGVDSIGKKLVNSKEGPPTFEQPKMTIEKLLEYGNMLVQEQENVKRVQLADKYLSEAALGDANSDAMNTGTFYG

SEQ ID NO: 284 - DNA, 1329 bp, Nicotiana tabacum
atggctacctctgtctcaaccattggagctgttaacaaaacaccgttgagtttgaacaactcagttgctggaacttcagttccaagcacagccttctttggcaaaactttgaagaaagtgtatggaaaaggtgtttcaagccccaaggttacaaacaagagcttgaggattgtagctgaacaaatagatgttgatccgaagaaacagaccgacagtgacagatggaagggtcttgtccaagacttctccgatgatcaacaggacatcacccggggtaagggtatggttgacagtcttttccaggctccaacgggtactggtactcaccacgctgtgttgcaatcctacgaatacgtcagccaaggtcttcgccagtacaacttggacaacaagttggacggattctacatcgctcctgctttcatggacaagcttgttgttcacatcaccaagaacttcttgaaattgcccaacatcaaggttccacttatcttgggtatctggggaggcaaaggtcaaggcaaatcattccagtgtgaacttgtcttcagaaagatgggaatcaaccccattatgatgagtgctggagaattggaaagtggaaatgcaggagagccagccaagttgattaggcaaaggtacagagaagcagcagaaatcatcagaaagggaaatatgtgttgcctcttcatcaacgatctcgatgcaggagctggtagaatgggtggaactacccaatacactgtcaacaaccaaatggtgaatgccactctcatgaacattgctgacaacccgacaaatgtccagctccccggtatgtacaacaagcaagagaatgccagggtccctattatcgtcactggtaacgatttctccacattgtatgctccacttatccgtgatggtcgtatggagaagttctactgggcaccaactagggaagacagaattggtgtttgcacaggtattttcaggaccgacaatgttcctgctgaagacgttgtcaagattgttgataacttccctggacaatctatcgacttttttggtgcactgagggcgagagtatacgatgatgaagtaaggaagtgggtatcaggcactggaattgaaaagattggagacaaacttttgaactcttttgacggaccaccaacttttgagcaaccaaagatgaccattgagaagctcctcgagtacggtaatatgcttgtacaagagcaagaaaatgtgaagagagttcagttggctgacaaatacctcaaagaggctgcacttggtgatgccaatgctgatgccattaacaatggatccttctttgctagttag

SEQ ID NO: 285 - protein, 442 aa, Nicotiana tabacum
MATSVSTIGAVNKTPLSLNNSVAGTSVPSTAFFGKTLKKVYGKGVSSPKVTNKSLRIVAEQIDVDPKKQTDSDRWKGLVQDFSDDQQDITRGKGMVDSLFQAPTGTGTHHAVLQSYEYVSQGLRQYNLDNKLDGFYIAPAFMDKLVVHITKNFLKLPNIKVPLILGIWGGKGQGKSFQCELVFRKMGINPIMMSAGELESGNAGEPAKLIRQRYREAAEIIRKGNMCCLFINDLDAGAGRMGGTTQYTVNNQMVNATLMNIADNPTNVQLPGMYNKQENARVPIIVTGNDFSTLYAPLIRDGRMEKFYWAPTREDRIGVCTGIFRTDNVPAEDVVKIVDNFPGQSIDFFGALRARVYDDEVRKWVSGTGIEKIGDKLLNSFDGPPTFEQPKMTIEKLLEYGNMLVQEQENVKRVQLADKYLKEAALGDANADAINNGSFFAS

SEQ ID NO: 286 - DNA, 1401 bp, Oryza sativa
atggctgctgccttctcctccaccgttggagctccggcgtccactccgaccaacttcctggggaagaagctgaagaagcaggtgacatcggcggtgaactaccatggcaagagctccaacatcaacaggttcaaggtgatggccaaggagctggacgagggcaagcagaccgaccaggacaggtggaagggtctcgcctacgacatctccgatgaccagcaggacatcaccagggggaagggtttcgtcgactcccttttccaggctcccacgggtgatggcacccacgaggccgtcctcagctcctacgagtacctcagccagggtctcagaacgtacgacttcgacaacaccatgggaggcttctacatcgcccctgctttcatggacaagctcgtcgtccacatctccaagaacttcatgaccctccccaacatcaaggtcccactcatcctgggtatctggggaggcaagggtcagggaaaatccttccagtgtgagctcgtcttcgccaagatggggatcaaccccatcatgatgagcgccggagagctggagagcggcaacgccggagagccggcgaagctgatcaggcagcggtaccgtgaggcggcagacatcatcaagaaggggaagatgtgctgcctcttcatcaacgatctggacgcgggtgcaggtcgcatgggaggcaccacccagtacacggtgaacaaccagatggtgaacgccaccctgatgaacatcgccgacaacccaaccaacgtgcagctccccgggatgtacaacaaggaggacaacccccgtgtccccatcatcgtcaccggcaacgacttctccacgctgtacgcgccgctcatccgtgacgggcgtatggagaagttctactgggctcccacccgcgacgaccgtgtcggcgtctgcaagggtatcttccgcaccgacaacgtccccgacgaggacatcgtcaagatcgtcgacagcttcccaggccaatccatcgatttcttcggcgctcttcgtgcccgtgtttacgacgacgaggtgcgcaagtgggtgtcggacacgggtgtggagaacattggcaagaggctggtgaactcgagggagggcccaccggagttcgagcagcccaagatgacgatcgaaaagctcatggagtacggatacatgcttgtgaaggagcaggagaacgtcaagcgtgtgcagctggctgagcagtacttgagcgaggctgctcttggtgacgctaactccgacgccatgaagactggttccttctacgggcaaggagcacagcaagcaggtaacctgcctgtgccggaaggttgcaccgaccctgttgccaagaacttcgacccaacggcgaggagcgacgacggcagctgcctttacaccttttaa

SEQ ID NO: 287 - protein, 466 aa, Oryza sativa
MAAAFSSTVGAPASTPTNFLGKKLKKQVTSAVNYHGKSSNINRFKVMAKELDEGKQTDQDRWKGLAYDISDDQQDITRGKGFVDSLFQAPTGDGTHEAVLSSYEYLSQGLRTYDFDNTMGGFYIAPAFMDKLVVHISKNFMTLPNIKVPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEDNPRVPIIVTGNDFSTLYAPLIRDGRMEKFYWAPTRDDRVGVCKGIFRTDNVPDEDIVKIVDSFPGQSIDFFGALRARVYDDEVRKWVSDTGVENIGKRLVNSREGPPEFEQPKMTIEKLMEYGYMLVKEQENVKRVQLAEQYLSEAALGDANSDAMKTGSFYGQGAQQAGNLPVPEGCTDPVAKNFDPTARSDDGSCLYTF

SEQ ID NO: 288 - DNA, 1302 bp, Oryza sativa
atggctgctgccttctcctccaccgttggagctccggcgtccactccgaccaacttcctggggaagaagctgaaaaagcaggtgacatcggcggtgaactaccatggcaagagctccaacatcaacaggttcaaggtgatggccaaggagctggacgagggcaagcagaccgaccaggacaggtggaagggtctcgcctacgacatctccgatgaccagcaggacatcaccagggggaagggtttcgtcgactcccttttccaggctcccacgggtgatggcacccacgaggccgtcctcagctcctacgagtacctcagccagggtctcagaacgtacgacttcgacaacaccatgggaggcttctacatcgcccctgctttcatggacaagctcgtcgtccacatctccaagaacttcatgaccctccccaacatcaaggtcccactcatcctgggtatctggggaggcaagggtcagggaaaatccttccagtgtgagctcgtcttcgccaagatggggatcaaccccatcatgatgagcgccggagagctggagagcggcaacgccggagagccggcgaagctgatcaggcagcggtaccgtgaggcggcagacatcatcaagaaggggaagatgtgctgcctcttcatcaacgatctggacgcgggtgcaggtcgcatgggaggcaccacccagtacacggtgaacaaccagatggtgaacgccaccctgatgaacatcgccgacaacccaaccaacgtgcagctccccgggatgtacaacaaggaggacaacccccgtgtccccatcatcgtcaccggcaacgacttctccacgctgtacgcgccgctcatccgtgacgggcgtatggagaagttctactgggctcccacccgcgacgaccgtgtcggcgtctgcaagggtatcttccgcaccgacaacgtccccgacgaggacatcgtcaagatcgtcgacagcttcccaggccaatccatcgatttcttcggcgctcttcgtgcccgtgtttacgacgacgaggtgcgcaagtgggtgtcggacacgggtgtggagaacattggcaagaggctggtgaactcgagggagggcccaccggagttcgagcagcccaagatgacgatcgaaaagctcatggagtacggatacatgcttgtgaaggagcaggagaacgtcaagcgtgtgcagctggctgagcagtacttgagcgaggctgctcttggtgacgctaactccgacgccatgaagactggttccttctacggttctgcgccatccagctga

SEQ ID NO: 289 - protein, 433 aa, Oryza sativa
MAAAFSSTVGAPASTPTNFLGKKLKKQVTSAVNYHGKSSNINRFKVMAKELDEGKQTDQDRWKGLAYDISDDQQDITRGKGFVDSLFQAPTGDGTHEAVLSSYEYLSQGLRTYDFDNTMGGFYIAPAFMDKLVVHISKNFMTLPNIKVPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEDNPRVPIIVTGNDFSTLYAPLIRDGRMEKFYWAPTRDDRVGVCKGIFRTDNVPDEDIVKIVDSFPGQSIDFFGALRARVYDDEVRKWVSDTGVENIGKRLVNSREGPPEFEQPKMTIEKLMEYGYMLVKEQENVKRVQLAEQYLSEAALGDANSDAMKTGSFYGSAPSS

SEQ ID NO: 290 - DNA, 1326 bp, Phaseolus vulgaris
atggctgcctccctctccactgtcggcgctgtcaacagaacccttttgaatctgaatggatctggaggcggagcttcaggtcccagttcagctttctttggcacaagcttgaagaaggttattagctcaagggtccctaacagcaagttgacatctggaagcttcaaaattgttgctgcagacaaagagatcgaggagacccagcagaccgagggggacagatggaggggtctagcctacgatgtttctgatgaccaacaagacatcacaagagggaagggtttggttgattctcttttccaagctccaatggatgctggaactcactatgcagtcatcagctcccacaagtacctcagcgctggactacgccagtacaactttgacaacatcaaggatggtttctacattgctccagcttttttggacaagcttgttgttcacatcgccaagaacttcatgaccttgcccaacatcaaggttcctctcattcttggtgtctggggaggcaagggacaaggaaaatctttccaatgtgagcttgtctttgccaagatgggaatcaaccccatcatgatgagtgctggagagttggaaagtggaaatgccggagagccagcaaaattgattaggcagagataccgtgaagcctcagacttaatcaagaagggaaagatgtgtgttctgttcatcaatgatcttgatgcaggagcaggtcgtcttggtggaaccacccaatacactgtgaacaaccagatggtgaatgccactctcatgaacattgctgataaccccacaaatgtgcagcttcctggtatgtacaacaaggaagataacgcccgtgtgcccatcattgtcactggtaacgatttctcaacactttatgctcctctcatccgtgatggtcgtatggagaagttctactgggcaccaacaagggaagaccgcattggtgtttgcaagggaattttccggaccgatggtgttcctgaaaaggacattgtcgagcttgttgacaaacaccctggccaatccattgatttctttggtgcactgagggccagagtgtatgatgatgaagtaaggaagtggatttctggtgttggtgttgattctgttgggaagaagcttgtgaactcaaaggaaggacctcctacctttgaccagcccaagatgactctggacaagctcttgctgtatgctagcatgcttgtccaagaacaagagaatgtgaagagagtccaattggctgaccagtacttgaatgaggctgctcttggaaatgccaacgaggatgctatcaagagtggatctttcttcaaatag

SEQ ID NO: 291 - protein, 441 aa, Phaseolus vulgaris
MAASLSTVGAVNRTLLNLNGSGGGASGPSSAFFGTSLKKVISSRVPNSKLTSGSFKIVAADKEIEETQQTEGDRWRGLAYDVSDDQQDITRGKGLVDSLFQAPMDAGTHYAVISSHKYLSAGLRQYNFDNIKDGFYIAPAFLDKLVVHIAKNFMTLPNIKVPLILGVWGGKGQGKSFQCELVFAKMGINPIMMSAGELESGNAGEPAKLIRQRYREASDLIKKGKMCVLFINDLDAGAGRLGGTTQYTVNNQMVNATLMNIADNPTNVQLPGMYNKEDNARVPIIVTGNDFSTLYAPLIRDGRMEKFYWAPTREDRIGVCKGIFRTDGVPEKDIVELVDKHPGQSIDFFGALRARVYDDEVRKWISGVGVDSVGKKLVNSKEGPPTFDQPKMTLDKLLLYASMLVQEQENVKRVQLADQYLNEAALGNANEDAIKSGSFFK

SEQ ID NO: 292 - DNA, 1299 bp, Triticum aestivum
atggcttctgctttctcgtccaccgttggagctccggcgtcgaccccgaccaccttcctcgggaagaaggtgaagaagcaggccggtgcgttgaactactaccatggtggcaacaagatcaacaatagggtggtcagggccatggcggccaaaaaggaacttgacgagggcaagcagaccgatgccgatcggtggaagggtctcgcttacgacatctccgatgaccagcaggacatcacgagggggaaaggcatcgtggactccctgttccaggcccccatgggcgacggcacccacgaggccatcctgagctcctacgagtacatcagccagggcctgcgcaagtacgacttcgacaacaccatggacgggctgtacatcgccccggcgttcatggacaagctcatcgtccacctcgccaagaacttcatgacactccccaacatcaaggtccctctcatcctgggtatctggggaggcaagggacagggcaagtcgttccagtgcgagctggtgttcgccaagatgggcatcaaccccatcatgatgagcgccggagagctggagagcggcaacgccggcgagccggccaagctgatccggcagaggtaccgcgaggctgccgacattatcaagaagggcaagatgtgctgcctcttcatcaacgacctggacgccggcgcggggcggatgggcgggacgacgcagtacacggtgaacaaccagatggtgaacgccaccctgatgaacatcgcggacgcgcccaccaacgtgcagttcccggggatgtacaacaaggaggagaacccacgcgtgcccatcatcgtcaccggcaacgacttctcgacgctgtacgcgcccctcatccgggacggccgcatggagaagttctactgggcgcccacccgggaggaccgcatcggcgtgtgcaagggcatcttccgcaccgacaacgtccccgacgaggccgtggtgaggctggtggacaccttcccggggcagtccatcgacttcttcggcgcgctgcgggcgcgggtgtacgacgacgaggtgcgcaagtgggtcggcgagatcggcgtcgagaacatctccaagcggctcgtcaactccagggaggggccgccgacgttcgaccagcccaagatgaccatcgagaagctcatggagtacggccacatgctggtccaggagcaggagaacgtgaagcgcgtgcagctcgccgacaagtacctcagcgaggcggcgctcggccaagccaacgacgacgccatggcgaccggcgccttctacggcaagtag

SEQ ID NO: 293 - protein, 432 aa, Triticum aestivum
MASAFSSTVGAPASTPTTFLGKKVKKQAGALNYYHGGNKINNRVVRAMAAKKELDEGKQTDADRWKGLAYDISDDQQDITRGKGIVDSLFQAPMGDGTHEAILSSYEYISQGLRKYDFDNTMDGLYIAPAFMDKLIVHLAKNFMTLPNIKVPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADAPTNVQFPGMYNKEENPRVPIIVTGNDFSTLYAPLIRDGRMEKFYWAPTREDRIGVCKGIFRTDNVPDEAVVRLVDTFPGQSIDFFGALRARVYDDEVRKWVGEIGVENISKRLVNSREGPPTFDQPKMTIEKLMEYGHMLVQEQENVKRVQLADKYLSEAALGQANDDAMATGAFYGK

SEQ ID NO: 294 - DNA, 1299 bp, Zea mays
atggccgccttctcctccaccgtcggagctccggcctccaccccgaccaggagcagcttcctcgggaagaagctcaacaagccgcaggtgtccgcggccgtgacctaccatggcaagagctccagcagcaacagcaggttcaaggcgatggctgccaaggaggtggacgagacgaagcagaccgacgaggacaggtggaagggcctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaacttcgacaacatgatggatggcttctacatagccaagggcttcatggacaagctcgtcgtccacctctccaagaacttcatgaccctgccaaacatcaaggttcccctcatcctgggtatctggggaggcaaaggccagggaaaatcgttccaatgcgagctggtcttcgccaagatgggcatcacccccatcatgatgagcgccggcgagctggagagcggcaacgccggagagcccgccaagctcatcaggcagcgctaccgtgaggcctccgacctcatcaagaagggcaagatgtcctgcctcttcatcaacgacctcgacgccggcgcgggtcgcatgggcggcaccacccagtacacggtgaacaaccagatggtcaacgccaccctgatgaacatcgccgacaaccccaccaacgtgcagctcccggggatgtacaacaaggaggacaacccccgcgtgcccatcatcgtcaccggcaacgacttctccacgctctacgcgccgctcatccgcgacggccgcatggagaagttctactgggcgcccacccgcgaggaccgcatcggcgtctgcaagggcatcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgctggtggcggagcaggagaacgtcaagcgtgtgcagcttgctgacaagtacctcaacgaggctgctcttggtgaagccaacgaggacgccatgaagactggctccttcttcaagtag

SEQ ID NO: 295 - protein, 432 aa, Zea mays
MAAFSSTVGAPASTPTRSSFLGKKLNKPQVSAAVTYHGKSSSSNSRFKAMAAKEVDETKQTDEDRWKGLAYDISDDQQDITRGKGLVDNLFQAPMGDGTHVAVLSSYDYISQGQKSYNFDNMMDGFYIAKGFMDKLVVHLSKNFMTLPNIKVPLILGIWGGKGQGKSFQCELVFAKMGITPIMMSAGELESGNAGEPAKLIRQRYREASDLIKKGKMSCLFINDLDAGAGRMGGTTQYTVNNQMVNATLMNIADNPTNVQLPGMYNKEDNPRVPIIVTGNDFSTLYAPLIRDGRMEKFYWAPTREDRIGVCKGIFRTDGVDEEHVVQLVDTFPGQSIDFFGALRARVYDDEVRRWVSETGVENIARKLVNSKEGPPTFEQPKITIEKLLEYGHMLVAEQENVKRVQLADKYLNEAALGEANEDAMKTGSFFK

SEQ ID NO: 296 - DNA, 1122 bp, Datisca glomerata
atggcttcttccgctgtctcaaccattggagcagtcaacagatcccctttaaatttgaacaacaatggaactggagggttgctgccaaacacagccttctttggcagcagtctgaagaagatgaactcaagattgaccaatccgaggattgctgctggcaacattaaggctgttgctgacgatgacgaggaaaaacaaacatcgaaggacaggtggggaggccttgcctttgacacatctgatgaccaacaagacattaccagaggaaagggaatggttgattcccttttccaagctcccatgcaaactggaactcactatgctgtcatgagctcttatgaatacctcagcactggtcttcgccaatacttggataacaatatggatggattctacatagctccagctttcatggacaagcttgtcgttcacatcaccaaaaacttcatgactctccccaacataaaggttcctctcattttgggtatctggggaggtaaaggtcaaggtaaatctttccagtgtgagcttgtctttgccaagatgggaatcaaccccatcatgatgagtgccggagaattggagagcggcaacgcaggagagcccgcgaagttgatcaggcaacggtgtcgtgaggcggccgacatcatcaagaagggaaagatgtcttgcctatttatcaatgatcttgatgcaggtgccggtaggcttggtgggacaactcaatacactgtgaacaaccaaatggtgaatgctaccctcatgaacattgctgacaatccaaccaatgttcagctcccgggtatgtacaacaaggaagagaatccacgtgtaccgatcatcgtcacaggtaatgacttctcgacattgtacgctcctctcattcgtgatggtcgtatggagaaattctactgggcgcccaccagagaagaccgaattggtgtctgcactggtatcttcagaagtgacaatgtggctaaggaagatattgtcaagcttgttgacacattccctggtcaatctattgatttcttcggggcgctaagagcacgggtttacgacgacgaagtgaggaagtggatatcgggtgtcggagtacaggacgttggaaaaagcttgtga

SEQ ID NO: 297 - protein, 373 aa, Datisca glomerata
MASSAVSTIGAVNRSPLNLNNNGTGGLLPNTAFFGSSLKKMNSRLTNPRIAAGNIKAVADDDEEKQTSKDRWGGLAFDTSDDQQDITRGKGMVDSLFQAPMQTGTHYAVMSSYEYLSTGLRQYLDNNMDGFYIAPAFMDKLVVHITKNFMTLPNIKVPLILGIWGGKGQGKSFQCELVFAKMGINPIMMSAGELESGNAGEPAKLIRQRCREAADIIKKGKMSCLFINDLDAGAGRLGGTTQYTVNNQMVNATLMNIADNPTNVQLPGMYNKEENPRVPIIVTGNDFSTLYAPLIRDGRMEKFYWAPTREDRIGVCTGIFRSDNVAKEDIVKLVDTFPGQSIDFFGALRARVYDDEVRKWISGVGVQDVGKSL

SEQ ID NO: 298 - DNA, 1308 bp, Zantedeschia aethiopica
gccgtctccagcgtcggtgccgtgaacagggtccggcctagcctacatgggtctggttcgggagcctcggtgacgaggtccggcttcctgggcaccagcctgaagacggtgaaccccagcttgggtcatggcaggacctccactgggaccttgaaggtcatggctgctgacctcgacgagagcaagcagaccaagacagacaggtgggctgggctgtacaccgacacctcggatgaccagcaggacatcaccagggggaagggcatggtcgactccctgttccaggctcccatgggcgacggaacccacaaccccgtcctgagctcctacgagtacatcagcaccggtctccgctcgttcaacttggacaacaccgtgaatggtttatacatcgctccggccttcatggacaagcttgtcgttcacatcaccaagaacttcatgaacttgcccaacatcaagattcctctcattttgggtatctggggaggcaaaggtcaagggaaatccttccaatgtgaacttgtgttcgccaagatgggaatcaaccccatcatgatgagcgccggtgagctggagagcggcaacgccggagagccggcgaagctgatccggcagcggtaccgtgaggccgccgacatcatcaggaaggggaagatgtgctgcctcttcatcaacgatctcgatgccggtgccggccggatgggcggcaccacccagtacaccgtcaacaaccagatggtgaacgccaccctcatgaacatcgccgacaaccccaccaacgtccagctccccggcatgtacaacaagcaagagaacccccgcgtgcccatcatcgtcaccggcaacgacttctccaccctctacgcccccctcatccgtgacggtcgtatggagaagttctactgggctcccaccagggatgaccgggtcggcgtctgcaccggtatcttcaggtccgacaacgtccccaaggaggatgtcatcaagctcgtcgacaccttccccggccaatccattgacttcttcggtgcactgagggcgagggtctacgacgacgaggtgaggaagtggattgccgaaatcggcgtcgacggcgtggggaagaggctggtgaactcgctggaggggccgccgacgttcgcgcagcccaagatgaccctggacaagctgctggagtacggcaatatgctggtgcaggaacaggagaacgtgaagagggtgcagctggccgacaagtacctgagcgaggcagctcttggtgacgccaatcaggacgcgatcaagactggatccttctatggttag

SEQ ID NO: 299 - protein, 435 aa, Zantedeschia aethiopica
AVSSVGAVNRVRPSLHGSGSGASVTRSGFLGTSLKTVNPSLGHGRTSTGTLKVMAADLDESKQTKTDRWAGLYTDTSDDQQDITRGKGMVDSLFQAPMGDGTHNPVLSSYEYISTGLRSFNLDNTVNGLYIAPAFMDKLVVHITKNFMNLPNIKIPLILGIWGGKGQGKSFQCELVFAKMGINPIMMSAGELESGNAGEPAKLIRQRYREAADIIRKGKMCCLFINDLDAGAGRMGGTTQYTVNNQMVNATLMNIADNPTNVQLPGMYNKQENPRVPIIVTGNDFSTLYAPLIRDGRMEKFYWAPTRDDRVGVCTGIFRSDNVPKEDVIKLVDTFPGQSIDFFGALRARVYDDEVRKWIAEIGVDGVGKRLVNSLEGPPTFAQPKMTLDKLLEYGNMLVQEQENVKRVQLADKYLSEAALGDANQDAIKTGSFYG

SEQ ID NO: 300 - DNA, 1245 bp, Anabaena variabilis
atgagttattatatcgctccgcgctttctggataaacttgctgttcacatcaccaaaaactttttaaatattcctggtgtgcgagttcccttaattttagggattcatggacgtaaaggagaagggaaaacctttcagtgtgagttagcttttgagaagatgggtattgaagtcacactcatctccggcggtgaattggaaagtcccgatgcgggagacccagcccggttgattcggctgcgctatcgggaaacggcagaactgattaaagtgcggggtaaaatgtgcgtgctgatgattaacgatttagatgcaggtgcaggacgctttgatgaaggtacgcaatatactgtaaatactcagttggtaaatgccacactgatgaatattgccgataatcccacagatgtacagttacccggtagttatgattccaacccgatacggcgtgtccccattatcgtgacaggtaatgatttttctactctctacgcaccattgattcgggatggacggatggagaaattctattgggaacccaaccgcgatgataaggtgggaattgtcggggggatttttgctgaggatggactctcaaaacgagaaattgaacaattagttgatactttccccaagcaatcgattgacttttttagcgctttacgttctcgaatttacgacgaacaaatccgcgactttatccatcaagttgggtttgaacgtatatctctacgtgttgtgaacagcgtagaagcgccgccagaatttaaaaagccagatttcagccttgctcatttgatcgagtctggtaacttggtgttgggtgaacaacaacgggtagacaattctcagctagtggatgagtataatcgattgaatcgcgggaggggttatcaagcagcgccaccgcctgaagcgcccatgattcagccagtcaataatagttctcacaagcgagagacatctaatactcatttgagtttagaaacccaagaacaaatccggcaaatcttgtctcaaggtcacaaaattacttttgaacacgtagatgcacgccgcttccgcacgggttcttggcaaagttgcggtactctgcatattgatgcagagtcagatgctatttcaacactagaggcttgcttagttgattatgagggtgagtatgtgcgcttggtagggatagacccgaaaggtaagcggcgggttgtggagacaattattcaacgaccaaatgacaaaaactaa

SEQ ID NO: 301 - protein, 414 aa, Anabaena variabilis
MSYYIAPRFLDKLAVHITKNFLNIPGVRVPLILGIHGRKGEGKTFQCELAFEKMGIEVTLISGGELESPDAGDPARLIRLRYRETAELIKVRGKMCVLMINDLDAGAGRFDEGTQYTVNTQLVNATLMNIADNPTDVQLPGSYDSNPIRRVPIIVTGNDFSTLYAPLIRDGRMEKFYWEPNRDDKVGIVGGIFAEDGLSKREIEQLVDTFPKQSIDFFSALRSRIYDEQIRDFIHQVGFERISLRVVNSVEAPPEFKKPDFSLAHLIESGNLVLGEQQRVDNSQLVDEYNRLNRGRGYQAAPPPEAPMIQPVNNSSHKRETSNTHLSLETQEQIRQILSQGHKITFEHVDARRFRTGSWQSCGTLHIDAESDAISTLEACLVDYEGEYVRLVGIDPKGKRRVVETIIQRPNDKN

SEQ ID NO: 302 - DNA, 1245 bp, Nostoc sp.
atgagttattatatcgctccgcgttttctggataaacttgctgttcacatcactaaaaactttttgaatattcctggtgtgcgagttcccttaattttagggattcatggacgtaaaggagaagggaaaacctttcaatgtgagttagcttttgaaaagatgggtattgaagtcacactcatctctggcggtgaattggaaagtcccgatgcgggagacccagcacggttgattcggctgcgttatcgggaaacggcagaactgatcaaagtgcgcggtaaaatgtgcgtgctgatgattaacgatttagatgcaggtgcaggacgctttgatgaaggtacgcaatatactgtaaatactcagttggtaaatgccacgctgatgaatattgctgataatcctacagatgtgcagttaccgggtagttatgattccaacccgatacggcgtgtccccattatcgtcacaggtaatgatttttctactctctacgcgccattgattcgggatggacggatggagaaattctattgggaacccaaccgtgatgataaggtgggaattgttggggggatttttgcggaagatggactgtcacaacgggaaattgagcaattagttgatactttccccaagcaatcgattgacttttttagcgctttacgttctcgaatttacgatatccaaatccgcgacttcatccataaagtcgggtttgaacggatatctttgcgcgtagtgaacagcctagaagcgccgccagaatttaaaaagccagatttcagcctggctcatttaatcgagtctggtaacttggtgttgggtgaacaacaacgggtagataattctcagttagtggatgagtataatcgattaaatcgcgggagaggttatcaaacagcgccaccccccgaagcaccagtgattcagccagtcaataatagttctcacaagcaaaagacatctaatactcatttgagtttagaaacccaagaacaaatccggcaaatcttgtctcaaggtcacaaaattacctttgaacacgtagatgcacgccgtttccgcacgggttcttggcagagttgcggtactctgcatattgatgcagagtcagatgctatttcaactttagaggcttgcttagttgattatgacggtgagtatgtgcggatggtagggatagacccgaaaggcaagcggcgggttgtagagacaattattcaacgaccaaatggcaaaaattaa

SEQ ID NO: 303 - protein, 414 aa, Nostoc sp.
MSYYIAPRFLDKLAVHITKNFLNIPGVRVPLILGIHGRKGEGKTFQCELAFEKMGIEVTLISGGELESPDAGDPARLIRLRYRETAELIKVRGKMCVLMINDLDAGAGRFDEGTQYTVNTQLVNATLMNIADNPTDVQLPGSYDSNPIRRVPIIVTGNDFSTLYAPLIRDGRMEKFYWEPNRDDKVGIVGGIFAEDGLSQREIEQLVDTFPKQSIDFFSALRSRIYDIQIRDFIHKVGFERISLRVVNSLEAPPEFKKPDFSLAHLIESGNLVLGEQQRVDNSQLVDEYNRLNRGRGYQTAPPPEAPVIQPVNNSSHKQKTSNTHLSLETQEQIRQILSQGHKITFEHVDARRFRTGSWQSCGTLHIDAESDAISTLEACLVDYDGEYVRMVGIDPKGKRRVVETIIQRPNGKN

SEQ ID NO: 304 - DNA, 1224 bp, Synechococcus sp.
atgagctactacatcccccccacctttcttaaagttgtcgccctgcacctgaccaaaaatcatcttcctctgcccgacgtgcccgttccgctcatcttgggcatccacgggcgcaagggggagggcaagaccttccaatgcaacctcatctttgagcgcatgaaggtctatgccgtccacatctcggggggcgagctggaaagtcccgacgccggggatcccgcccgtatgattcgcctgcgctaccgtgaagctgccgagcacatccgcaaatttggccagatggccgtgctgatgatcaacgacctggatgccggcgccggtcgcctgaacagcatgacccagtacaccgtcaacacccaactggtgagcgccaccctgatgaacatcgccgacaaccccaccaacgtgcagcttcccggcagctacgatcccaagcccctgccgcgggtgcccatcatcgccaccggcaacgacttttccaccctctatgcccccctcatccgcgatgggcgcatgcgcaagttctactgggagcccagccgcaccgaccgcatccacatcgttcacggcatttttcaagccgacgggctgtctcttgaggagattgagcgcctggtggacgcctttcccgagcaggccatcgactttttcggcgccctgcgcgcccagctctacgacgagcaggtatggcaatttatccaagaagtcggcctggaagggattgcctttcgcctgctcaaaagcaaagagggcgccccccagtttccgccaccgcgattttctctggagcagttgatccaggccggccaccagctcaaagccgagcaacaccaagtagaagcccgtcgcctctccgaggaataccttggcctccggcgctccgctcctcaagagccgccccccgcttccccgccatcccctcctcctgtggctgccaactcggccgatcctgccccagtctccctcaacccagacgtgcaggcccagcttcgccagatcctggcccaaggctatgagatcctggtggagcatgcggatccgcgccgctaccgcgttcattcctggcaggagtgtggagttgcccacctgagagaatgggccgctgcctgtcaggctgtcgagcagtgcctcagccgttttcccaaggactacatccggctggtgggcgtagatccggtgaaaaaacaacggcgggtcgaggccatcatccaccgcccctga

SEQ ID NO: 305 - protein, 407 aa, Synechococcus sp.
MSYYIPPTFLKVVALHLTKNHLPLPDVPVPLILGIHGRKGEGKTFQCNLIFERMKVYAVHISGGELESPDAGDPARMIRLRYREAAEHIRKFGQMAVLMINDLDAGAGRLNSMTQYTVNTQLVSATLMNIADNPTNVQLPGSYDPKPLPRVPIIATGNDFSTLYAPLIRDGRMRKFYWEPSRTDRIHIVHGIFQADGLSLEEIERLVDAFPEQAIDFFGALRAQLYDEQVWQFIQEVGLEGIAFRLLKSKEGAPQFPPPRFSLEQLIQAGHQLKAEQHQVEARRLSEEYLGLRRSAPQEPPPASPPSPPPVAANSADPAPVSLNPDVQAQLRQILAQGYEILVEHADPRRYRVHSWQECGVAHLREWAAACQAVEQCLSRFPKDYIRLVGVDPVKKQRRVEAIIHRP

SEQ ID NO: 306 - DNA, 2193 bp, Oryza sativa; identical to SEQ ID NO: 146

SEQ ID NO: 307 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcgcccttctcgcaggattcagcc

SEQ ID NO: 308 - DNA, 1179 bp, Oryza sativa
ttgcagttgtgaccaagtaagctgagcatgcccttaacttcacctagaaaaaagtatacttggcttaactgctagtaagacatttcagaactgagactggtgtacgcatttcatgcaagccattaccactttacctgacattttggacagagattagaaatagtttcgtactacctgcaagttgcaacttgaaaagtgaaatttgttccttgctaatatattggcgtgtaattcttttatgcgttagcgtaaaaagttgaaatttgggtcaagttactggtcagattaaccagtaactggttaaagttgaaagatggtcttttagtaatggagggagtactacactatcctcagctgatttaaatcttattccgtcggtggtgatttcgtcaatctcccaacttagtttttcaatatattcataggatagagtgtgcatatgtgtgtttatagggatgagtctacgcgccttatgaacacctacttttgtactgtatttgtcaatgaaaagaaaatcttaccaatgctgcgatgctgacaccaagaagaggcgatgaaaagtgcaacggatatcgtgccacgtcggttgccaagtcagcacagacccaatgggcctttcctacgtgtctcggccacagccagtcgtttaccgcacgttcacatgggcacgaactcgcgtcatcttcccacgcaaaacgacagatctgccctatctggtcccacccatcagtggcccacacctcccatgctgcattatttgcgactcccatcccgtcctccacgcccaaacaccgcacacgggtcgcgatagccacgacccaatcacacaacgccacgtcaccatatgttacgggcagccatgcgcagaagatcccgcgacgtcgctgtcccccgtgtcggttacgaaaaaatatcccaccacgtgtcgctttcacaggacaatatctcgaaggaaaaaaatcgtagcggaaaatccgaggcacgagctgcgattggctgggaggcgtccagcgtggtggggggcccacccccttatccttagcccgtggcgctcctcgctcctcgggtccgtgtataaataccctccggaactcactcttgctggtcaccaacacgaagcaaaaggacaccagaaacatagtacacttgagctcactccaaactcaaacactcacacca

SEQ ID NO: 309 - DNA, 55 bp, Artificial sequence
  primer: prm08444
ggggacaagtttgtacaaaaaagcaggcttaaacaatgcaggtcaccatgaagag

SEQ ID NO: 310 - DNA, 50 bp, Artificial sequence
  primer: prm08445
ggggaccactttgtacaagaaagctgggtctcctacagaggaggcacatc

SEQ ID NO: 311 - protein, 199 aa, Artificial sequence
  Chlre_RCA domain
ILGIWGGKGQGKTFQCALAYKKLGIAPIVMSAGELESGNAGEPAKLIRTRYREASDIIKKGRMCSLFINDLDAGAGRMGDTTQYTVNNQMVNATLMNIADNPTNVQLPGVYKNEEIPRVPIVCTGNDFSTLYAPLIRDGRMEKYYWNPTREDRIGVCMGIFQEDNVQRREVENLVDTFPGQSIDFFGALRARVYDDMVR

SEQ ID NO: 312 - protein, 8 aa, Artificial sequence
  Motif 1
  VARIANT (2)..(2): Xaa is Gly or Arg
  VARIANT (5)..(5): Xaa is Gln or Glu
  VARIANT (8)..(8): Xaa is Ser or Thr
GXKGXGKX

SEQ ID NO: 313 - DNA, 1317 bp, Flaveria bidentis
atggccaccgccgccatcggagccaccttcaaccgcaccccgttgagcagtggtgttgctgcggtcccgagttcgagcttcttaggcactagcttgaagaagattgtgaactcgagacatgcagtcaacaacaacaagttttccactttcaagatctttgcagccgagaaagagatcgaagagaccaaacaaaccgacaaagatagatggagaggactcgcgtatgatatgtcggatgatcaacaagacatcactagaggtaagggtatggttgattctctcttccaggctccacaagattctggaacccatttcgctgtcatgagttcctacgaatacatcagcactggtcttcgcacatatttggacaacaacatggatggattctatatcgcgcctgcgtttatggacaagctcgttgttcacatcaccaagaacttcatgactttgcccaacattaaggtccctctaattttgggtgtttggggaggcaaaggtcagggtaaatctttccaatgtgaacttgtgtttgccaagatgggaatcacaccgattatgatgagtgctggagaattggaaagtggaaacgccggagagcccgcgaagctcatcagacagcggtaccgtgaggcggccgatatcatcaagaaggggaaaatgtgttgcctcttcatcaatgatcttgatgcaggagcaggtagaatgggtggaacaacacaatacacagtcaacaaccagatggtcaacgctaccctcatgaacattgctgataaccccaccaatgtgcaactgcctggaatgtacaacaaggaggagaacccgcgtgtcccgatcatcgtcacaggaaacgacttttcgacactctatgctcccctcattcgtgacggtcgtatggaaaagttctattgggctcccactagagatgaccgaattggcgtgtgtattggtattttccgcactgacaatgtcccgaaagaagacattgtcaaactcgtcgatactttccctggacaatccattgatttctttggcgcgttgagggctagagtgtacgacgatgaagtgaggaagtggatcggagaagttggtgttgaaaccattggaaagaagcttgtgaactcaagggaaggacccccgacattcgagcaacccaaaatgacaatcgataagctccttgagtacggatacatgcttgttcaggaacaagagaatgtgaagagagtccagttggccgatacctatttggattctgcggcgcttggtgacgctaacaaggatgccatggagactggcaaattctttgccggaaaagaatag

SEQ ID NO: 314 - protein, 438 aa, Flaveria bidentis
MATAAIGATFNRTPLSSGVAAVPSSSFLGTSLKKIVNSRHAVNNNKFSTFKIFAAEKEIEETKQTDKDRWRGLAYDMSDDQQDITRGKGMVDSLFQAPQDSGTHFAVMSSYEYISTGLRTYLDNNMDGFYIAPAFMDKLVVHITKNFMTLPNIKVPLILGVWGGKGQGKSFQCELVFAKMGITPIMMSAGELESGNAGEPAKLIRQRYREAADIIKKGKMCCLFINDLDAGAGRMGGTTQYTVNNQMVNATLMNIADNPTNVQLPGMYNKEENPRVPIIVTGNDFSTLYAPLIRDGRMEKFYWAPTRDDRIGVCIGIFRTDNVPKEDIVKLVDTFPGQSIDFFGALRARVYDDEVRKWIGEVGVETIGKKLVNSREGPPTFEQPKMTIDKLLEYGYMLVQEQENVKRVQLADTYLDSAALGDANKDAMETGKFFAGKE

SEQ ID NO: 315 - DNA, 1248 bp, Ostreococcus lucimarinus
atgtccacgatcacgcagccgcgatgcggcgtcaaggcgaacgccacggcgaagcgcgccgtcgcgccgaagaccttcctcggcgcgcgcgtctcctccgtgtcgaacggttccaaggttgagatgagccgatggaagggcatggacatggacatttccgacgaccagcaagacatcgctcgcggccgcaacatggttgactccaagttccaaggcgcgaccggaatcggtggtacgcacaacgccgtcatgtcctcgcaagattacttgtccgcgggcatgaagacgtactctgcgcacgacaacatcaccacggagaacttctacatctccccgtcgtacatggacaaggtgatcgtgcacgtcgcgaagaacttcatgaagttgccgaagatcaaggtgccggtcattctcggtgtctggggtggtaagggtcaaggtaagactttccagtctgatttgatcttcaagaagctcggcatctccccgatcgtcatgtccgccggtgagctcgaatccggcaacgccggtgaaccggccaagctcgtgcgtcagcgttaccgcgaagcgtccgacatcgtcaagaagggtcgcatgtctaccctcttcatcaacgatcttgacgctggtgccggtcgtatgggtggcacgacgcaatacaccgtcaacaaccaaatggtgaacgcgacgctcatgaacatcgcggataaccccacgaacgttcagttgccgggccaatacgaagtcatcgaaatcccgcgtgtgccgatcatcgccaccggtaacgatttctccaccctttacgcgccgctcgtccgtgatggccgtatggacaagttctactggtccccgacccgcgaagaccgcgtcggcatcgccaacggtatcttcatggcggatggcatcgagaaggaagacgtcgaagtcctcgtcgatacgttcgaaggtcaatccattgacttcttcggcgcgcttcgctcccgtgtctacgatgacttggtgcgtgacttcatcctcgaagtcggctacgaagctctcggcccgcgcctcatcaacccgcgcaagggtgaagaagtcaacttcaacccgccgaaaatgacgctcgaagtcctcttggcgtacggtaaggaattggagaacgagcaagagaacatcaagcgcatccagttggccgatgcctacttggacggcgccgtgctcgcgggcgaaggcggttcctcgaacaccgagaagtcgctcaaccagtaa

SEQ ID NO: 316 - protein, 415 aa, Ostreococcus lucimarinus
MSTITQPRCGVKANATAKRAVAPKTFLGARVSSVSNGSKVEMSRWKGMDMDISDDQQDIARGRNMVDSKFQGATGIGGTHNAVMSSQDYLSAGMKTYSAHDNITTENFYISPSYMDKVIVHVAKNFMKLPKIKVPVILGVWGGKGQGKTFQSDLIFKKLGISPIVMSAGELESGNAGEPAKLVRQRYREASDIVKKGRMSTLFINDLDAGAGRMGGTTQYTVNNQMVNATLMNIADNPTNVQLPGQYEVIEIPRVPIIATGNDFSTLYAPLVRDGRMDKFYWSPTREDRVGIANGIFMADGIEKEDVEVLVDTFEGQSIDFFGALRSRVYDDLVRDFILEVGYEALGPRLINPRKGEEVNFNPPKMTLEVLLAYGKELENEQENIKRIQLADAYLDGAVLAGEGGSSNTEKSLNQ

SEQ ID NO: 317 - DNA, 1320 bp, Vigna radiata
atggctgcctccgtctccactgtcggagctgtcaacagagctattttgaacctgaatggatcaggagcaggagcttcagctcccacttcagctttctttggcacaagcttgaagaaggctgttgcctcaagggtccctaacagcaaggtgacgaatggaagcttcaaaattgttgctgctgagaaagagattgaggagagccagcagaccaacaaggacagatggaagggtctggcctacgatatctctgatgaccaacaagacatcacaagggggaagggtatggttgatcctcttttccaagctccaatggatgctggaacacactatgccgtcatgagctcctacgaataccttagcactggactccgacagcttgacaacataaaggatggtttctacattgctcctgcttttctggacaagcttgttgttcacatcaccaagaacttcatgaccttgcccaacatcaaggttcctctcattcttggtatctggggaggcaagggacaaggaaagtctttccaatgtgagcttgtctttgccaagatgggaatcaaccccatcatgatgagtgctggagagttggaaagtggaaatgccggagagccagcaaaattgatcaggcagagataccgtgaagctgcagatttgatcgccaagggaaagatgtgtgctctattcatcaacgatcttgatgcaggagcaggtcgtcttggtggaaccacccaatacactgtgaacaaccagatggtgaatgccactctcatgaacattgctgataaccctacaaatgtgcagcttcctggtatgtacaacaaggaagagaacgcccgtgtgcccatcattgtcaccggtaatgatttctcaacgctgtatgctcctctcattcgtgatgggcgtatggagaagttctactgggcaccaacaagggacgaccgcgttggtgtttgcaagggaattttccgcaccgatggtgttcctgaagaggacattacaaagcttgttgacaccttcccaggccaatctattgatttctttggtgcactgagggccagagtgtatgatgatgaagtgaggaagtggatttctggtgttggtgttgatgctactgggaagaagcttgtgaactcaaaggaaggacctcctacctttgatcagcccaagatgagtctggacaagctcttgcagtatggtaacatgcttgtccaagaacaagaaaatgtgaagagagtccaattggctgacaagtacttgaatgaggctgctcttggaaatgctaacgaagatgctattaagagtggatctttcttcaaatag

SEQ ID NO: 318 - protein, 439 aa, Vigna radiata
MAASVSTVGAVNRAILNLNGSGAGASAPTSAFFGTSLKKAVASRVPNSKVTNGSFKIVAAEKEIEESQQTNKDRWKGLAYDISDDQQDITRGKGMVDPLFQAPMDAGTHYAVMSSYEYLSTGLRQLDNIKDGFYIAPAFLDKLVVHITKNFMTLPNIKVPLILGIWGGKGQGKSFQCELVFAKMGINPIMMSAGELESGNAGEPAKLIRQRYREAADLIAKGKMCALFINDLDAGAGRLGGTTQYTVNNQMVNATLMNIADNPTNVQLPGMYNKEENARVPIIVTGNDFSTLYAPLIRDGRMEKFYWAPTRDDRVGVCKGIFRTDGVPEEDITKLVDTFPGQSIDFFGALRARVYDDEVRKWISGVGVDATGKKLVNSKEGPPTFDQPKMSLDKLLQYGNMLVQEQENVKRVQLADKYLNEAALGNANEDAIKSGSFFK

SEQ ID NO: 319 - DNA, 1230 bp, Volvox carteri
atgcagaccaccatgaagggcagcgccatctctggccagcgcgtgggcagcgcccgcgtcgccgcacgtagcgtgcgcagggctcagcttcaggttgtagctgctagccgctctcaggttggtcgctggcgcaatatcgacgccgatgttgacacctcggacgaccagcaagacatcacccgcggtcgccagatggtcgacgacctcttccagggtggcttcggcgccggtggcacgcacaacgccgtgctgtcgtccaccgagtacctgagccaggcccgcgcctcgttcaacaacattgaggatggtttctacatctcaccggctttccttgacaagatgaccatccacattgctaagaacttcatggatctgccgaagattaaagtcccactcattctcggcatctggggtggcaagggtcagggcaagactttccagtgcgctctggcgtacaagaagctcggcatctcacccattgtcatgtcggctggtgagctcgagtccggcaatgctggtgagcctgccaagctgatccgcacccgctaccgggaggcgtccgacatcatcaagaagggcaagatgtgctccctgttcatcaacgatctggatgctggtgctggccgtatgggtgacaccacccagtacaccgtcaacaaccagatggtcaacgcaacgctgatgaacattgccgataacccgaccaacgtgcagctgccgggtgtctacaagaacgaggagatcccccgcgtgccaatcgtctgcacgggtaacgacttctcgaccctgtacgctcccctcattcgtgatggccgtatggagaagtactactggaaccccacccgcgaggaccgcattggtgtgtgcatgggcatcttccaggaggacaacgtcagccgtggcgacgttgagcgcctggtcgacaccttccctggccaatccattgatttcttcggcgccctccgcgctcgcgtctacgatgacatggtgcgcaagtggattgccgaggtcggcattgagggcatcggcagcaagctggtcaacggcaggcagaaggtgtcgttccctaaggtgtcgatgtcgctggacgtgctgctgaagtacggccgcgccctggttgacgagcaggagaacgtcaagcgcgtgcagctggccgatgcctacctgtctggtgccgagctggctggccgtgagggctcgtcgctgccggaggagtactctcgccggtaa

SEQ ID NO: 320 - protein, 409 aa, Volvox carteri
MQTTMKGSAISGQRVGSARVAARSVRRAQLQVVAASRSQVGRWRNIDADVDTSDDQQDITRGRQMVDDLFQGGFGAGGTHNAVLSSTEYLSQARASFNNIEDGFYISPAFLDKMTIHIAKNFMDLPKIKVPLILGIWGGKGQGKTFQCALAYKKLGISPIVMSAGELESGNAGEPAKLIRTRYREASDIIKKGKMCSLFINDLDAGAGRMGDTTQYTVNNQMVNATLMNIADNPTNVQLPGVYKNEEIPRVPIVCTGNDFSTLYAPLIRDGRMEKYYWNPTREDRIGVCMGIFQEDNVSRGDVERLVDTFPGQSIDFFGALRARVYDDMVRKWIAEVGIEGIGSKLVNGRQKVSFPKVSMSLDVLLKYGRALVDEQENVKRVQLADAYLSGAELAGREGSSLPEEYSRR

SEQ ID NO: 321 - DNA, 693 bp, Arabidopsis thaliana
  variation (143)..(143): n is c or t
atgccaaacactagcagctctcaaagcttcactatcttcgttgatggttggttaatccgtcacaggtatttcgttgaacagcttatgtgtgcttcttccttggatgaaactaatcgtatctctctcgaagaacaacaatctcncgtggcccagtttctatctcactgtcttcaatactaccaagagaaattcgcctccgtttccctcgccggggacaacgttttcactttcttctgcccaccgtggtttaactcctacgctaaacttattttatgggtcggcgatttcaagccttctcttgtgtttaaactcaccgaggtctccgtggccgacctcacgcgccaccagaaagaccggatctcgagtcttaagtcggagactaggaggaaagagagagaagttatgcgagatttcgccctcgtgcaacaaagcgtggcggatccgccggtgatgctcgcggcgaggcgcgtgggagcggtgggaatggtggacggagaagaaacggatttggaggaggcgatggaggtgcttaaagctgggatggcggcagcgatgaacaacgctgatcagctacggtgttcgacggtggggaaagtggtggagattcttactccgccgcaagcgattaaagtgttgaggacaatcggacagcttcacctccgtctgagagacagagaccaagaaagagcttaa

SEQ ID NO: 322 - protein, 230 aa, Arabidopsis thaliana
  VARIANT (48)..(48): Xaa is Leu or Pro
MPNTSSSQSFTIFVDGWLIRHRYFVEQLMCASSLDETNRISLEEQQSXVAQFLSHCLQYYQEKFASVSLAGDNVFTFFCPPWFNSYAKLILWVGDFKPSLVFKLTEVSVADLTRHQKDRISSLKSETRRKEREVMRDFALVQQSVADPPVMLAARRVGAVGMVDGEETDLEEAMEVLKAGMAAAMNNADQLRCSTVGKVVEILTPPQAIKVLRTIGQLHLRLRDRDQERA

SEQ ID NO: 323 - DNA, 849 bp, Arabidopsis thaliana
atggcgactagttcttcgagttatgggattgaacaacttcaaaaaggatgttactatgagtggatgagtgtgcaggctaaacacatagttgatctcaaagaagcactcatgagtcatcgatccaaagaagatcacaagcttgaagaactcgttggtaaaatcgtcaatgacttccaaaaatacaccgaaaaacgatctgagctctctcgccgaagctgctcaagctactttgcaccgtcgtggaactctcctctagagaacggtttactatggatgggaggatgtcgtccatcgtctttcattagagttatttactctctttgtggatcccaagccgaaacgcagctttctcagtatcttctaaagatcgatgaaaatgtcgaagtaaaccatggtggttccatgagtgatctaaacgcgtcgcagcttgcaaaaatcaatgatttgcatataaaggttatagagaaagaggacaagataacaaagaaatcggcgaatttgcaagagaatgttgcggatatgcctatagccatcgcggcttatgccacggacttgatgaatggtgacgtggtggtggaagatgctttagataagtatgaggagggcatggcggttttaatggtggaagctgataaactgaggtttgagacgcttaggaagatcgtggatgttgttacgccggttcaagcggcggagtttttgctcgcagggaaaagattacacatatcattgcacgagtggggaagagttagagaagagcaacgttttgggtgtgtacgtacggatgcagcggctgccacgggaggagcgggaaccgagaagtcaaagaggtcaagcttgttgatgtga

SEQ ID NO: 324 - protein, 282 aa, Arabidopsis thaliana
MATSSSSYGIEQLQKGCYYEWMSVQAKHIVDLKEALMSHRSKEDHKLEELVGKIVNDFQKYTEKRSELSRRSCSSYFAPSWNSPLENGLLWMGGCRPSSFIRVIYSLCGSQAETQLSQYLLKIDENVEVNHGGSMSDLNASQLAKINDLHIKVIEKEDKITKKSANLQENVADMPIAIAAYATDLMNGDVVVEDALDKYEEGMAVLMVEADKLRFETLRKIVDVVTPVQAAEFLLAGKRLHISLHEWGRVREEQRFGCVRTDAAAATGGAGTEKSKRSSLLM

SEQ ID NO: 325 - DNA, 708 bp, Arabidopsis thaliana
atgagtttacaaactaaacacatagatgatctcaaagaagcactcatgtgtcaacgaaacaacgatgacaaactcgaagacctcgttggtaaaatcgtcaatgactaccacacatatgcgggaaaacgatcagagctctcgtaccgatgctgcgctcactactttgcaccgtcgtggaacactcctatagagaacagtatgctatggatgggaggatgtcgtccttcttctttcattagacttatatacgcactttgtggatcccaggccgaaactcagctttctcaatatcttcttaagatcgatgacgacttcgatataaaccatggtggtttcatgagtgatcttaccgcgacacagcttggaaaactcaatgacttgcatttggaggtaataaagaaagaagacaagattacgaagacatctgcgaattttcaagacgatgtggcggatttgccaatcgcggatgtggtgcatgctgatgtagcggtggaggatgctttggataagcatgaagagggaatggcggttttactggcggaggctgataaactgaggtttgagacgcttaggaagattgtggacgttgtcacaccgcttcaagcggtggagtttttgcttgccggaaaaagattacagctgtcgttgcacgaccggggaagagttagagcagatgtttgtggaggagtggggggcgccgctgtctga

SEQ ID NO: 326 - protein, 235 aa, Arabidopsis thaliana
MSLQTKHIDDLKEALMCQRNNDDKLEDLVGKIVNDYHTYAGKRSELSYRCCAHYFAPSWNTPIENSMLWMGGCRPSSFIRLIYALCGSQAETQLSQYLLKIDDDFDINHGGFMSDLTATQLGKLNDLHLEVIKKEDKITKTSANFQDDVADLPIADVVHADVAVEDALDKHEEGMAVLLAEADKLRFETLRKIVDVVTPLQAVEFLLAGKRLQLSLHDRGRVRADVCGGVGGAAV

SEQ ID NO: 327 - DNA, 790 bp, Arabidopsis thaliana
atagaatataaccactaatgagcaaaatgagaaacctagtagaagaaaagttcctagagttctatgagagttgggttattcaacttgagctatatcttcatcaacttttaattgctcataacaataacactatgagtgagaccgagcttcgacatttgatctcgaagctaactacacatcacaaagcttattatacagccaaatgggcagccataagagaagatgtcttagcttttttcggatcagtttggttaaacccgttagagaatgcttgctcttggttaaccggatggaaaccgtcgatggtgtttcggatggttgataggctgaggaagtcgagagtggtgcttgtggaggctcaggtgaagaaattggaggagctgagagttaagaccaagttcgatgagcaaaaaattgagagagagatggagcggtatcaggtggctatggctgatcggaaaatggtagagctggcgaggcttggatgtcacgtcggaggagaatcggtgatggtggtggaggcagcggtgagaggattatcgatgggtcttgagaaaatggtgaaggctgcggattgtgtgcggctgaaaacgcttaaaggtatattagacattttaactccaccgcaatgcgttgagtttttggcagcggcggctacgtttcaggttcagttacgtcggtggggaaaccgaagacattatgtcactcactcctgacacaaacttaagagttattttctctgttctgttttttttttttttcatattacaataagaatgaaatttttaac

SEQ ID NO: 328 - protein, 232 aa, Arabidopsis thaliana
MSKMRNLVEEKFLEFYESWVIQLELYLHQLLIAHNNNTMSETELRHLISKLTTHHKAYYTAKWAAIREDVLAFFGSVWLNPLENACSWLTGWKPSMVFRMVDRLRKSRVVLVEAQVKKLEELRVKTKFDEQKIEREMERYQVAMADRKMVELARLGCHVGGESVMVVEAAVRGLSMGLEKMVKAADCVRLKTLKGILDILTPPQCVEFLAAAATFQVQLRRWGNRRHYVTHS

SEQ ID NO: 329 - DNA, 905 bp, Arabidopsis thaliana
cttggaactatatatgagtcatgccaatcactagcagctctgaaacttttgcgagcttcttcaatgactggctctgccgtcacaggcaattcgtccaacaacttgcacaccttgctgatgaaacaaccattgtaactccaatagaagaagaatctcttgtgagtaactttctttctcactatctccaatactacgaagagaaatcagttgccatgtccgtggccggtgacgatatatatgatttcttctctccaccatggctcagctcatacgagaaactcatcctctggatcggaggttttaaaccaggtatggtttttaagctcataaccacttctgttaatgaccttacgagccaccaaatagaccaactcgagagcattcggttagagactaaacggagggagagagatttgatgcgaaggttcgcgcttctacaacagagcgtgggggatccacttctgatggttccatttaggcgcatcggagtgttgaggcttggcgaaggagagcagccagaaatggaggatgcaatggaggttttgaaggtagagatgattaaagcgatgaagaacgctgatcaactccggtgtgtgacggttgggaaagtggtggaggttctgaatccacggcagtcgatcaagctgctaagagccgctggagagttttatctccggctgagagatttaggtgtgtagagagaaacagttctttgctaggactttaatgttctttttttttttttttgagtgttctaagtatttcgaaatcaggtttggtcttataagtgaacaacatttgttctacaataaaaacaaatccggtagtgcttatgtataggtttgggctttggacatgagttttgtatgtaattacgtttcatgccatcgtacttttagttctct

SEQ ID NO: 330 - protein, 225 aa, Arabidopsis thaliana
MPITSSSETFASFFNDWLCRHRQFVQQLAHLADETTIVTPIEEESLVSNFLSHYLQYYEEKSVAMSVAGDDIYDFFSPPWLSSYEKLILWIGGFKPGMVFKLITTSVNDLTSHQIDQLESIRLETKRRERDLMRRFALLQQSVGDPLLMVPFRRIGVLRLGEGEQPEMEDAMEVLKVEMIKAMKNADQLRCVTVGKVVEVLNPRQSIKLLRAAGEFYLRLRDLGV

SEQ ID NO: 331 - DNA, 1095 bp, Arabidopsis thaliana
atgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaagcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaa

SEQ ID NO: 332 - protein, 364 aa, Arabidopsis thaliana
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQAEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 333 - DNA, 2204 bp, Triticum aestivum
gaattccggcgacggcggcagtctactaccccgtagttcggatagaggcccctcttcctatcgagtgtttaggcatatatctgcagctttgtcacaacaaaggaatctctctgggagttacattgagcactatgaataatctgcaatggcagaggccagccctagaacagaaacgtcaacagatgatactgatgaaaatcttatgcttgaaccagggaatgctgctcttgctgttgtttctgactctagtgacagatccagagacaaaaacggagatcaaaagacaatgcgtcggcttgctcaaaatcgcgaggctgctaggaaaagtcgtttgaggaaaaaggcatatgttcaacaattggagaacagcaggctaaagcttacccagctagagcaggagttgcaacgagctcgtcaacaaggcatttttatatctagttcagcagaccagtcccattccatgagtggaaatggggcgttggcttttgacacggagtacgcacggtggttggaagaacacaatcgacaagttaatgagctgagagctgcagttaatgctcatgcaggcgatactgagctgcgtagtgttgttgagaagatcatgtcacactatgatgagatttttaagcaaaaaggaaatgcagccaaagcagatgtctttcatgtgttatcaggcatgtggaagacaccagctgagaggtgtttcctatggcttggaggtttccgaccttctgagcttttaaagcttctttcgacccagcttgaacccctaactgagcagcagctgtcagggatatgcaaccttcagcaatcatcacaacaagctgaggatgctctttcacaaggaatggaggctcttcagcagtctttggcagaaacgttggctgggtctatcggctcttctggatctggatcaacaggaaatgtggcaaactacatggggcaaatggccatggccatgggaaagcttggaacccttgaaaatttccttagtcaggctgacaacctgcggcagcagactcttcagcagatgcaaaggatcctgaccacaaggcagtctgcccgtgcacttcttgtgataagtgattactcatcccggcttcgtgccctaagttctctttggcttgctcgaccgaaggaataacaagcgcgtgtgatttgactgcaatacattttcgcaatttgggggtgatggtggtggcagtcatgcaacagacttgattcagagaaacttgcacatactataatccaaagagatgctgtgttcaggtagcttagccatatagtgaagttgagtgcattagggaagggtccttgttgtaccgttaaccgctgtaaaattggcatctaatggttgccaagtaatctttaagatactaatttgcagagagccatccctttagatgtgcatttataactcttttgttgctaatcggaaaaaaaaaaggaggaagagcgagctaggcaagaggctatcgcgaaaaaggctgcagaagacaacaaggatcagccctcaagctctaccgatgctattatggctgaagcggaacttaccttaaatgctcctgctgatcttgacgcagatctactcaaggatgatgatgatgctcagctactacagcaagcacttgctatgtcaatggatgagggtgcttcaggagctgcagccgtggctgatgctgctatggcagaagctgctgcagatgaccaggatttggcattggctcttcaaatgtctgtccaggacgctgaggcggctggtcaatctgatatgagcaaagtgtttgaagacagatcatttgtgacatccatccttaattcgcttcctggtgttgaccccaatgacccatctgtgaaagatctactggcatctttgcatggccaaggagagcaggaggagaagaaagataaggaggacaagccagacatttctgaagatgggaagaactgaaggcaatgaacatctattttctcggaaaagtgcaggcgcatgaagtgaagaagattgcctgcattagctgcttttacactcgggctctatgaatttacttaatcctcttgtaactgcgttgatgataactgccgagagaacttgtattatgtctgctctcacgaatgctccttcatgtttgtcttaagtgattacatgttgcaaattcatttgtacactttatgtctgttgaaggtgaaattgaacggaattc

SEQ ID NO: 334 - protein, 332 aa, Triticum aestivum
MAEASPRTETSTDDTDENLMLEPGNAALAVVSDSSDRSRDKNGDQKTMRRLAQNREAARKSRLRKKAYVQQLENSRLKLTQLEQELQRARQQGIFISSSADQSHSMSGNGALAFDTEYARWLEEHNRQVNELRAAVNAHAGDTELRSVVEKIMSHYDEIFKQKGNAAKADVFHVLSGMWKTPAERCFLWLGGFRPSELLKLLSTQLEPLTEQQLSGICNLQQSSQQAEDALSQGMEALQQSLAETLAGSIGSSGSGSTGNVANYMGQMAMAMGKLGTLENFLSQADNLRQQTLQQMQRILTTRQSARALLVISDYSSRLRALSSLWLARPKE

SEQ ID NO: 335 - DNA, 1259 bp, Oryza sativa
ctccaccacaggttcagctcgcctcctcccgtagccaacttccacgcagagatcgccaaccaccatgccgccgccgtcgccgcacccacctcaccgcaacggcaaccacgtcccggcgccctccggcgagtcgttcgccaagttcttcgagtgctggatctccgagcagtcccgcgacctcgccgcgctccgctccgccgcgtcggcggcgacgaaccccgcggcgccgcccgacgacgccgagctccaccgcctcgtcaaccgggtcctcggccactacgagcactactaccggaccaagtccgccgccgcctccaccgacgtgctccgcatgttctccccgtcgtggacctccaccaccgagaacctctacctctggtgcggcggatggcgccccactgccgcgctccacctgctctactccaagtccggcgcgcagctcgagacccagctcccggtgttcctcgccggcggcggcctcggggcgggcgacctcggcgacctctccgccgagcagctccaggccgccgaccagcttcagcggataaccgtcagcaaggaacgggagatcgagaacgccgccgcgagtgcacaggagtcgttggcgacggtgaagatggtggagctagccggaggcggcgggatggacgcggaggggatggagatggagatgaggagcaaggcggacgggatgaggcgcgtgctggagatggcagacgggctgaggctggagacgatgagggaggtggtggcgctgctccgcccgtcgcaggccgtgcacttcctcatcgccgccgccgagctccacctcgccgtgcacgagttcggcaggcgcaaggacggcgacggcgccgcgtcgccgccgccggcgtgacgcgtgcgcgctcgtgtcgtgtcgttgccgttccaagtgcgcggcgtggtctccgatgcgtaggctcgtcgtctagctctggtcaactcaagtcgtcgcgataagctttgaccgatatttatttatgcagtactcgtacactagtatttctctctctctctcttttttttctgcgatgaagccgatgatacctgtagggttttttttttctttcttttttgcgtttgcatgtgatggaattttactaccgtactttggagcagctgtttctatatagacagtgagctaacctgcgtgatatttctaatcaattcgggaagggaaggataaaattgttttttgttgctatgtgttcgaatcttaatgttaatcacaccgcttaacc

SEQ ID NO: 336 - protein, 269 aa, Oryza sativa
MPPPSPHPPHRNGNHVPAPSGESFAKFFECWISEQSRDLAALRSAASAATNPAAPPDDAELHRLVNRVLGHYEHYYRTKSAAASTDVLRMFSPSWTSTTENLYLWCGGWRPTAALHLLYSKSGAQLETQLPVFLAGGGLGAGDLGDLSAEQLQAADQLQRITVSKEREIENAAASAQESLATVKMVELAGGGGMDAEGMEMEMRSKADGMRRVLEMADGLRLETMREVVALLRPSQAVHFLIAAAELHLAVHEFGRRKDGDGAASPPPA

SEQ ID NO: 337 - DNA, 834 bp, Oryza sativa
atgcgaacccccgcggcgccgtgcgcgcgcgcgtgtccgccgcacgccaagaaaccgcgcccgatttatgccggcccagggtgggaggggcaaagaatgccggcgtcgtacctgcagccgcgccgcgggacgaacgggcggcgtattatggagcacggcgcgggcgaggagatggtggcgttctacgaggcgtgggtggggcgcgaggagcggatcgtcgcggacctcacggacgcgctcctcccggcgcggcggcggcgggacgtgctcgccccgctcgtggacgccgcggtgggccacgtgtcggagtactacgagcgcaaggcccgcctcgccgaccgcgacgtggtggcggcgctggacccgcgctggctcaacccgctcgagcgcaccttcctctgggcgtggggctggaagcccgcgctggtgttccgcttcgcggacggcgccgtcgccggcggctcgtcgcaccagcagcagcgccgcgcgctggagcgcgtgcgcgccgccaccgcggaggccgagcgggaggtggaccgggaggtggcggtcgtgcaggagtcgctcgccggaccccgcgtgctggcggcgctgcggaggcagcacccgcggaacggcgaggccgacgaggccgtcgccgcggtcgggcgctcgctccgcgtgctgctcgccgcggccgacgcgctccgcgagcgcacggtgcgggacgtcgtcgggacgctcgcgccagaccaggccggcgcgttcctcgcggccatgctgaggttccacctcggcgtgcaccgcgccggccgcaactggggctccggcaacggcggccggcggggcctctag

SEQ ID NO: 338 - protein, 277 aa, Oryza sativa
MRTPAAPCARACPPHAKKPRPIYAGPGWEGQRMPASYLQPRRGTNGRRIMEHGAGEEMVAFYEAWVGREERIVADLTDALLPARRRRDVLAPLVDAAVGHVSEYYERKARLADRDVVAALDPRWLNPLERTFLWAWGWKPALVFRFADGAVAGGSSHQQQRRALERVRAATAEAEREVDREVAVVQESLAGPRVLAALRRQHPRNGEADEAVAAVGRSLRVLLAAADALRERTVRDVVGTLAPDQAGAFLAAMLRFHLGVHRAGRNWGSGNGGRRGL

SEQ ID NO: 339 - DNA, 1093 bp, Nicotiana glauca X Nicotiana langsdorffii
cttaaataaatggcttcctcgttaatgaagagaaacggagtggaaaaaaacgacaagacgtttcacgagttttttgaaacatggctagctgagcagaagcaagaattgaaagagctggtttctgcctcgagagatgtaagtaaaggtaataataatgtggtggaagagagggtgttggtgccactcattaaacgggttatacaacactatgaggggtattatgaggagaagtcaaaatatacagaggaagatgtttttgggatgttaaatcctacatggaggagtaatcttgagggagctttcttatggattggaggttggagaccaagcatggcctttcacttgctctattcaaaatcagggttgcaattcgaagctcgtcttccccagttgattagaggaatcacaacgggtgacttagggtacctctctccggaccaaatagataaggttgatgaactgcaaaagaaaactataagggaggaaaaaaaatcgagtgagaaactagccagggttcaagaaactgttgcagatgcatcaatggtggagttatcccatattgtgactcagctgatgatgattagtggaagccgaggaggaggaggaggaggaggaaaaatactcgatgaagaagtggaagcaaatctggcaacaaaggaggaaggtctaataataatcctgcaaaaggcagataatctaaggctaaacactctcaaggaaattttagccattttgacaccaactcaagcaattcatttcctgattgctgctgctgagctccatttaaggcttcacgagtggggcaagatagaggatgcaaccgcctcgcgaacaccagcccgccgctactaccaccaccatcaccaactttaatcacttgatctaaacacactcatcaattgtgctagtttgggatgccccactattataagtatgatctagtttgcgttcggtcttatgttagtttgtatgtgtgtccacgtgcagcaaatagtactagtacctaaaaatgatgggaaaaaaaaattagtttaatttggttgtagaaacatgcttgttacatttcagaagcctttcatttgtaatagaattc

SEQ ID NO: 340 - protein, 287 aa, Nicotiana glauca X Nicotiana langsdorffii
MASSLMKRNGVEKNDKTFHEFFETWLAEQKQELKELVSASRDVSKGNNNVVEERVLVPLIKRVIQHYEGYYEEKSKYTEEDVFGMLNPTWRSNLEGAFLWIGGWRPSMAFHLLYSKSGLQFEARLPQLIRGITTGDLGYLSPDQIDKVDELQKKTIREEKKSSEKLARVQETVADASMVELSHIVTQLMMISGSRGGGGGGGKILDEEVEANLATKEEGLIIILQKADNLRLNTLKEILAILTPTQAIHFLIAAAELHLRLHEWGKIEDATASRTPARRYYHHHHQL

SEQ ID NO: 341 - DNA, 762 bp, Gossypium hirsutum
atgacgagtccggtcggtgaacggttctcggagttttttgataagtggatatgtcaacttgatgggtatttacaacagttagtaagggtgtctagggaaggtttaagtgaaagtgagcatcaaactttggtttcgaaactgactgctcattataaagaatattacactgttaaatgggcagctgcacatgaagatgtgcttgtgttttattgtccggtttggttaagtaagttagagaatgcttgttcatggttaaccggttggaaaccgtctatgatattcggtgtagttgagtcaatgaggaggaagagtgtggctgagttgacggaggagcaagtgcgaaagatagaacagttgagggtgaagataaagttggaagaagagaaagtggaaagggaaatggagaggcaacaagtggcaatggctgatcggaaaatggttgagttggttcgtacggcgaggcggataaggaatgaggagctggtggtggtggttgggaatcatcaggtggagggtttagttgaagtggcgctgaagggtgtacttgcagggctagaaagggtgatgaaagcggccgattgtgtgagactcaaggccttgaaaggtgttttggatgttttgaatccatcacagtcactggatttcttggctgggatctgcatgcttcagattcagatcaggaaatggggccaaaacagggataaccaaaagggttcgaatccgataatattaggagaactacacaacaatgtcattttttaa

SEQ ID NO: 342 - protein, 253 aa, Gossypium hirsutum
MTSPVGERFSEFFDKWICQLDGYLQQLVRVSREGLSESEHQTLVSKLTAHYKEYYTVKWAAAHEDVLVFYCPVWLSKLENACSWLTGWKPSMIFGVVESMRRKSVAELTEEQVRKIEQLRVKIKLEEEKVEREMERQQVAMADRKMVELVRTARRIRNEELVVVVGNHQVEGLVEVALKGVLAGLERVMKAADCVRLKALKGVLDVLNPSQSLDFLAGICMLQIQIRKWGQNRDNQKGSNPIILGELHNNVIF

SEQ ID NO: 343 - protein, 282 aa, Arabidopsis thaliana; identical to SEQ ID NO: 324

SEQ ID NO: 344 - protein, 235 aa, Arabidopsis thaliana; identical to SEQ ID NO: 326

SEQ ID NO: 345 - protein, 232 aa, Arabidopsis thaliana; identical to SEQ ID NO: 328

SEQ ID NO: 346 - protein, 225 aa, Arabidopsis thaliana; identical to SEQ ID NO: 330

SEQ ID NO: 347 - protein, 364 aa, Arabidopsis thaliana; identical to SEQ ID NO: 332

SEQ ID NO: 348 - protein, 332 aa, Triticum aestivum; identical to SEQ ID NO: 334

SEQ ID NO: 349 - protein, 269 aa, Oryza sativa; identical to SEQ ID NO: 336

SEQ ID NO: 350 - protein, 277 aa, Oryza sativa; identical to SEQ ID NO: 338

SEQ ID NO: 351 - protein, 287 aa, Nicotiana glauca x Nicotiana langsdorffii; identical to SEQ ID NO: 340

SEQ ID NO: 352 - protein, 253 aa, Gossypium hirsutum; identical to SEQ ID NO: 342

SEQ ID NO: 353 - DNA, 56 bp, Artificial sequence
  primer: prm09230
ggggacaagtttgtacaaaaaagcaggcttaaacaatgccaaacactagcagctct

SEQ ID NO: 354 - DNA, 51 bp, Artificial sequence
  primer: prm09231
ggggaccactttgtacaagaaagctgggtagaagcagagcaaagcaaatta

SEQ ID NO: 355 - DNA, 1130 bp, Oryza sativa; identical to SEQ ID NO: 307

SEQ ID NO: 356 - protein, 349 aa, Unknown
  castor bean VPE
METHKSLLFFTNYVLFLVFTLSFLPIPGLLASRLNPFEPGILMPTEEAEPVQVDDDDQLGTRWAVLVAGSMGFGNYRHQADVCHAYQLLRKGGLKEENIIVFMYDDIAKNELNPRPGVIINHPQGEDVYAGVPKDYTGEHVTAKNLYAVLLGDKSAVQGGSGKVVDSKPNDRIFLYYSDHGGPGVLGMPNLPYLYAMDFIEVLKKKHAAGGYKKMVIYVEACESGSIFEGIMPKDVDIYVTTASNAQESSWGTYCPGMEPSPPPEFTTCLGDLYSVAWMEDSESHNLKKETVKQQYSSVKARTSNYNTYAAGSHVMQYGNQSIKADKLYLFQGFDPASVNFPPNNAHLN

SEQ ID NO: 357 - protein, 230 aa, Unknown
  SYPF1 polypeptide
MPNTSSSQSFTIFVDGWLIRHRYFVEQLMCASSLDETNRISLEEQQSLVAQFLSHCLQYYQEKFASVSLAGDNVFTFFCPPWFNSYAKLILWVGDFKPSLVFKLTEVSVADLTRHQKDRISSLKSETRRKEREVMRDFALVQQSVADPPVMLAARRVGAVGMVDGEETDLEEAMEVLKAGMAAAMNNADQLRCSTVGKVVEILTPPQAIKVLRTIGQLHLRLRDRDQERA

SEQ ID NO: 358 - protein, 364 aa, Unknown
  SYPF1 polypeptide
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQSEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 359 - protein, 493 aa, Artificial Sequence
  Consensus sequence
  misc_feature (2)..(2): Xaa can be any naturally occurring amino acid
  misc_feature (4)..(9): Xaa can be any naturally occurring amino acid
  misc_feature (11)..(11): Xaa can be any naturally occurring amino acid
  misc_feature (13)..(15): Xaa can be any naturally occurring amino acid
  misc_feature (17)..(18): Xaa can be any naturally occurring amino acid
  misc_feature (20)..(26): Xaa can be any naturally occurring amino acid
  misc_feature (28)..(39): Xaa can be any naturally occurring amino acid
  misc_feature (41)..(44): Xaa can be any naturally occurring amino acid
  misc_feature (46)..(48): Xaa can be any naturally occurring amino acid
  misc_feature (52)..(52): Xaa can be any naturally occurring amino acid
  misc_feature (54)..(54): Xaa can be any naturally occurring amino acid
  misc_feature (66)..(66): Xaa can be any naturally occurring amino acid
  misc_feature (69)..(69): Xaa can be any naturally occurring amino acid
  misc_feature (104)..(104): Xaa can be any naturally occurring amino acid
  misc_feature (106)..(107): Xaa can be any naturally occurring amino acid
  misc_feature (113)..(113): Xaa can be any naturally occurring amino acid
  misc_feature (117)..(117): Xaa can be any naturally occurring amino acid
  misc_feature (119)..(119): Xaa can be any naturally occurring amino acid
  misc_feature (121)..(121): Xaa can be any naturally occurring amino acid
  misc_feature (125)..(125): Xaa can be any naturally occurring amino acid
  misc_feature (135)..(135): Xaa can be any naturally occurring amino acid
  misc_feature (137)..(139): Xaa can be any naturally occurring amino acid
  misc_feature (153)..(153): Xaa can be any naturally occurring amino acid
  misc_feature (163)..(163): Xaa can be any naturally occurring amino acid
  misc_feature (167)..(167): Xaa can be any naturally occurring amino acid
  misc_feature (185)..(186): Xaa can be any naturally occurring amino acid
  misc_feature (192)..(192): Xaa can be any naturally occurring amino acid
  misc_feature (194)..(195): Xaa can be any naturally occurring amino acid
  misc_feature (204)..(204): Xaa can be any naturally occurring amino acid
  misc_feature (206)..(206): Xaa can be any naturally occurring amino acid
  misc_feature (209)..(209): Xaa can be any naturally occurring amino acid
  misc_feature (212)..(212): Xaa can be any naturally occurring amino acid
  misc_feature (229)..(230): Xaa can be any naturally occurring amino acid
  misc_feature (232)..(232): Xaa can be any naturally occurring amino acid
  misc_feature (235)..(235): Xaa can be any naturally occurring amino acid
  misc_feature (242)..(242): Xaa can be any naturally occurring amino acid
  misc_feature (253)..(253): Xaa can be any naturally occurring amino acid
  misc_feature (262)..(262): Xaa can be any naturally occurring amino acid
  misc_feature (278)..(279): Xaa can be any naturally occurring amino acid
  misc_feature (283)..(284): Xaa can be any naturally occurring amino acid
  misc_feature (288)..(288): Xaa can be any naturally occurring amino acid
  misc_feature (292)..(293): Xaa can be any naturally occurring amino acid
  misc_feature (296)..(296): Xaa can be any naturally occurring amino acid
  misc_feature (300)..(303): Xaa can be any naturally occurring amino acid
  misc_feature (306)..(306): Xaa can be any naturally occurring amino acid
  misc_feature (315)..(317): Xaa can be any naturally occurring amino acid
  misc_feature (319)..(320): Xaa can be any naturally occurring amino acid
  misc_feature (322)..(322): Xaa can be any naturally occurring amino acid
  misc_feature (324)..(324): Xaa can be any naturally occurring amino acid
  misc_feature (327)..(327): Xaa can be any naturally occurring amino acid
  misc_feature (329)..(330): Xaa can be any naturally occurring amino acid
  misc_feature (333)..(334): Xaa can be any naturally occurring amino acid
  misc_feature (337)..(340): Xaa can be any naturally occurring amino acid
  misc_feature (342)..(346): Xaa can be any naturally occurring amino acid
  misc_feature (348)..(349): Xaa can be any naturally occurring amino acid
  misc_feature (351)..(351): Xaa can be any naturally occurring amino acid
  misc_feature (359)..(361): Xaa can be any naturally occurring amino acid
  misc_feature (363)..(364): Xaa can be any naturally occurring amino acid
  misc_feature (369)..(370): Xaa can be any naturally occurring amino acid
  misc_feature (373)..(373): Xaa can be any naturally occurring amino acid
  misc_feature (376)..(376): Xaa can be any naturally occurring amino acid
  misc_feature (378)..(380): Xaa can be any naturally occurring amino acid
  misc_feature (383)..(383): Xaa can be any naturally occurring amino acid
  misc_feature (387)..(387): Xaa can be any naturally occurring amino acid
  misc_feature (390)..(390): Xaa can be any naturally occurring amino acid
  misc_feature (394)..(394): Xaa can be any naturally occurring amino acid
  misc_feature (397)..(397): Xaa can be any naturally occurring amino acid
  misc_feature (401)..(401): Xaa can be any naturally occurring amino acid
  misc_feature (406)..(407): Xaa can be any naturally occurring amino acid
  misc_feature (410)..(411): Xaa can be any naturally occurring amino acid
  misc_feature (414)..(415): Xaa can be any naturally occurring amino acid
  misc_feature (418)..(419): Xaa can be any naturally occurring amino acid
  misc_feature (421)..(421): Xaa can be any naturally occurring amino acid
  misc_feature (428)..(428): Xaa can be any naturally occurring amino acid
  misc_feature (432)..(433): Xaa can be any naturally occurring amino acid
  misc_feature (436)..(436): Xaa can be any naturally occurring amino acid
  misc_feature (439)..(440): Xaa can be any naturally occurring amino acid
  misc_feature (464)..(467): Xaa can be any naturally occurring amino acid
  misc_feature (472)..(474): Xaa can be any naturally occurring amino acid
  misc_feature (478)..(481): Xaa can be any naturally occurring amino acid
  misc_feature (483)..(483): Xaa can be any naturally occurring amino acid
  misc_feature (485)..(487): Xaa can be any naturally occurring amino acid
  misc_feature (489)..(489): Xaa can be any naturally occurring amino acid
SXLXXXXXXLXLXXXLXXLXXXXXXXSXXXXXXXXXXXXSXXXXPXXXDDDXNXGTRWAVLVAGSXGFXNYRHQADICHAYQLLRKGGLKEENIIVFMYDDIAXNXXNPRPGXIINXPXGXDVYXGVPKDYTGDXVXXXNLFAVILGDKSAVXGGSGKVVDSXPNDXIFIFYSDHGGPGVLGMPXXPYLYAXDXXDVLKKKHAXGXYKXLVXYLEACESGSIFEGILPXXLXIYXTTASNAXESSWGTYCPGXEPSPPPEFXTCLGDLYSVAWMEDSXXHNLXXETLXQQYXXVKXRTAXXXXYAXGSHVMQYGXXXIXXDXLXLFXGXXPAXXNFXXXXAXXXXXPXXVXNQRDADLXXXWXXYKKAXXGSXKKXEXXXQIXDAIXHRXHIDXSMXLIGXILFGXXKAXXILXXVRXXGXPLVDDWXCLKXXVRXFEXXCGSLSQYGIKHMRSFANICNAGIXXXXMEEAXXXACSXXXXGXWXXXNXGFSA

SEQ ID NO: 360 - protein, 508 aa, Artificial Sequence
  Consensus Sequence
  misc_feature (2)..(5): Xaa can be any naturally occurring amino acid
  misc_feature (7)..(8): Xaa can be any naturally occurring amino acid
  misc_feature (16)..(16): Xaa can be any naturally occurring amino acid
  misc_feature (18)..(19): Xaa can be any naturally occurring amino acid
  misc_feature (22)..(38): Xaa can be any naturally occurring amino acid
  misc_feature (45)..(60): Xaa can be any naturally occurring amino acid
  misc_feature (63)..(65): Xaa can be any naturally occurring amino acid
  misc_feature (115)..(115): Xaa can be any naturally occurring amino acid
  misc_feature (130)..(130): Xaa can be any naturally occurring amino acid
  misc_feature (132)..(132): Xaa can be any naturally occurring amino acid
  misc_feature (136)..(136): Xaa can be any naturally occurring amino acid
  misc_feature (197)..(197): Xaa can be any naturally occurring amino acid
  misc_feature (203)..(203): Xaa can be any naturally occurring amino acid
  misc_feature (240)..(240): Xaa can be any naturally occurring amino acid
  misc_feature (264)..(264): Xaa can be any naturally occurring amino acid
  misc_feature (266)..(266): Xaa can be any naturally occurring amino acid
  misc_feature (312)..(314): Xaa can be any naturally occurring amino acid
  misc_feature (317)..(317): Xaa can be any naturally occurring amino acid
  misc_feature (329)..(329): Xaa can be any naturally occurring amino acid
  misc_feature (331)..(332): Xaa can be any naturally occurring amino acid
  misc_feature (334)..(334): Xaa can be any naturally occurring amino acid
  misc_feature (353)..(353): Xaa can be any naturally occurring amino acid
  misc_feature (357)..(357): Xaa can be any naturally occurring amino acid
  misc_feature (359)..(359): Xaa can be any naturally occurring amino acid
  misc_feature (362)..(363): Xaa can be any naturally occurring amino acid
  misc_feature (376)..(376): Xaa can be any naturally occurring amino acid
  misc_feature (386)..(386): Xaa can be any naturally occurring amino acid
  misc_feature (389)..(389): Xaa can be any naturally occurring amino acid
  misc_feature (392)..(392): Xaa can be any naturally occurring amino acid
  misc_feature (398)..(398): Xaa can be any naturally occurring amino acid
  misc_feature (400)..(400): Xaa can be any naturally occurring amino acid
  misc_feature (403)..(403): Xaa can be any naturally occurring amino acid
  misc_feature (410)..(410): Xaa can be any naturally occurring amino acid
  misc_feature (419)..(421): Xaa can be any naturally occurring amino acid
  misc_feature (424)..(424): Xaa can be any naturally occurring amino acid
  misc_feature (427)..(427): Xaa can be any naturally occurring amino acid
  misc_feature (431)..(431): Xaa can be any naturally occurring amino acid
  misc_feature (434)..(434): Xaa can be any naturally occurring amino acid
  misc_feature (441)..(441): Xaa can be any naturally occurring amino acid
  misc_feature (452)..(452): Xaa can be any naturally occurring amino acid
  misc_feature (477)..(478): Xaa can be any naturally occurring amino acid
  misc_feature (482)..(482): Xaa can be any naturally occurring amino acid
  misc_feature (490)..(490): Xaa can be any naturally occurring amino acid
  misc_feature (495)..(497): Xaa can be any naturally occurring amino acid
  misc_feature (503)..(503): Xaa can be any naturally occurring amino acid
MXXXXIXXLLLLLLLXAXXSAXXXXXXXXXXXXXXXXXVIRLPSXXXXXXXXXXXXXXXXDDXXXGTRWAVLVAGSSGYWNYRHQADICHAYQILRKGGLKEENIVVFMYDDIAXNPENPRPGVIINHPXGXDVYXGVPKDYTGDDVTVDNFFAVLLGNKTAVTGGSGKVVDSGPNDHIFIYYSDHGGPGVLGMPTXPYLYAXDLIDVLKKKHASGTYKSLVFYLEACESGSIFEGLLPXDLNIYATTASNAEESSWGTYCPGXEXPSPPPEYETCLGDLYSVAWMEDSDVHNLKTETLKQQYELVKKRTAXXXSYXYGSHVMQYGDLXLXXDXLFLYIGTNPANDNFTFVEXNSLXSXSRXXVNQRDADLVHFWXKYRKAPEGSXRKXEAXKQLLEXMXHRXHIDNSVXLIGKLLFGXXXGPXVLXSVRXAGXPLVDDWXCLKSLVRTFEXHCGSLSQYGMKHMRSFANICNAGIXXEQMXEAAAQACXSIPTXXXPWSSLXRGFSA

SEQ ID NO: 361 - protein, 309 aa, Artificial Sequence
  Consensus Sequence
  misc_feature (4)..(8): Xaa can be any naturally occurring amino acid
  misc_feature (11)..(12): Xaa can be any naturally occurring amino acid
  misc_feature (14)..(14): Xaa can be any naturally occurring amino acid
  misc_feature (19)..(20): Xaa can be any naturally occurring amino acid
  misc_feature (22)..(22): Xaa can be any naturally occurring amino acid
  misc_feature (37)..(37): Xaa can be any naturally occurring amino acid
  misc_feature (40)..(40): Xaa can be any naturally occurring amino acid
  misc_feature (43)..(44): Xaa can be any naturally occurring amino acid
  misc_feature (46)..(46): Xaa can be any naturally occurring amino acid
  misc_feature (48)..(48): Xaa can be any naturally occurring amino acid
  misc_feature (50)..(54): Xaa can be any naturally occurring amino acid
  misc_feature (56)..(56): Xaa can be any naturally occurring amino acid
  misc_feature (58)..(60): Xaa can be any naturally occurring amino acid
  misc_feature (62)..(63): Xaa can be any naturally occurring amino acid
  misc_feature (70)..(70): Xaa can be any naturally occurring amino acid
  misc_feature (77)..(77): Xaa can be any naturally occurring amino acid
  misc_feature (80)..(80): Xaa can be any naturally occurring amino acid
  misc_feature (83)..(89): Xaa can be any naturally occurring amino acid
  misc_feature (91)..(93): Xaa can be any naturally occurring amino acid
  misc_feature (96)..(99): Xaa can be any naturally occurring amino acid
  misc_feature (101)..(120): Xaa can be any naturally occurring amino acid
  misc_feature (122)..(132): Xaa can be any naturally occurring amino acid
  misc_feature (135)..(135): Xaa can be any naturally occurring amino acid
  misc_feature (139)..(139): Xaa can be any naturally occurring amino acid
  misc_feature (146)..(148): Xaa can be any naturally occurring amino acid
  misc_feature (150)..(150): Xaa can be any naturally occurring amino acid
  misc_feature (152)..(155): Xaa can be any naturally occurring amino acid
  misc_feature (157)..(158): Xaa can be any naturally occurring amino acid
  misc_feature (160)..(160): Xaa can be any naturally occurring amino acid
  misc_feature (162)..(171): Xaa can be any naturally occurring amino acid
  misc_feature (174)..(174): Xaa can be any naturally occurring amino acid
  misc_feature (177)..(179): Xaa can be any naturally occurring amino acid
  misc_feature (181)..(183): Xaa can be any naturally occurring amino acid
  misc_feature (192)..(193): Xaa can be any naturally occurring amino acid
  misc_feature (195)..(199): Xaa can be any naturally occurring amino acid
  misc_feature (202)..(204): Xaa can be any naturally occurring amino acid
  misc_feature (208)..(209): Xaa can be any naturally occurring amino acid
  misc_feature (213)..(213): Xaa can be any naturally occurring amino acid
  misc_feature (217)..(217): Xaa can be any naturally occurring amino acid
  misc_feature (219)..(219): Xaa can be any naturally occurring amino acid
  misc_feature (223)..(223): Xaa can be any naturally occurring amino acid
  misc_feature (226)..(228): Xaa can be any naturally occurring amino acid
  misc_feature (231)..(248): Xaa can be any naturally occurring amino acid
  misc_feature (251)..(258): Xaa can be any naturally occurring amino acid
  misc_feature (260)..(262): Xaa can be any naturally occurring amino acid
  misc_feature (264)..(268): Xaa can be any naturally occurring amino acid
  misc_feature (270)..(270): Xaa can be any naturally occurring amino acid
  misc_feature (272)..(273): Xaa can be any naturally occurring amino acid
  misc_feature (281)..(281): Xaa can be any naturally occurring amino acid
  misc_feature (301)..(301): Xaa can be any naturally occurring amino acid
KNGXXXXXSSXXRXQATSXXGXREKEIVELFRKVQAXLRXRAXXKXEXKXXXXXSXGXXXEXXTVDSLLXLLRKHSXDQXKKXXXXXXXEXXXDQXXXXNXXXXXXXXXXXXXXXXXXXXEXXXXXXXXXXXRPXSNFXRRSPVPXXXFXPXXXXTXXDXDXXXXXXXXXXQKXKTXXXEXXXTDEPDSVSXXEXXXXXPDXXXEPEXXISLXDLDXIXDDEXESXXXEEXXXXXXXXXXXXXXXXXXSLXXXXXXXXDXXXDXXXXXAXGXXDLSSLKLXELRELAKSRGIKGYSKMKKXELVELLSS

SEQ ID NO: 362 - protein, 453 aa, Artificial Sequence
  Consensus Sequence
  misc_feature (11)..(14): Xaa can be any naturally occurring amino acid
  misc_feature (16)..(17): Xaa can be any naturally occurring amino acid
  misc_feature (19)..(20): Xaa can be any naturally occurring amino acid
  misc_feature (22)..(30): Xaa can be any naturally occurring amino acid
  misc_feature (32)..(32): Xaa can be any naturally occurring amino acid
  misc_feature (36)..(37): Xaa can be any naturally occurring amino acid
  misc_feature (41)..(52): Xaa can be any naturally occurring amino acid
  misc_feature (54)..(56): Xaa can be any naturally occurring amino acid
  misc_feature (58)..(59): Xaa can be any naturally occurring amino acid
  misc_feature (61)..(61): Xaa can be any naturally occurring amino acid
  misc_feature (63)..(67): Xaa can be any naturally occurring amino acid
  misc_feature (72)..(72): Xaa can be any naturally occurring amino acid
  misc_feature (77)..(77): Xaa can be any naturally occurring amino acid
  misc_feature (86)..(87): Xaa can be any naturally occurring amino acid
  misc_feature (111)..(111): Xaa can be any naturally occurring amino acid
  misc_feature (113)..(114): Xaa can be any naturally occurring amino acid
  misc_feature (118)..(118): Xaa can be any naturally occurring amino acid
  misc_feature (133)..(133): Xaa can be any naturally occurring amino acid
  misc_feature (135)..(138): Xaa can be any naturally occurring amino acid
  misc_feature (141)..(141): Xaa can be any naturally occurring amino acid
  misc_feature (234)..(234): Xaa can be any naturally occurring amino acid
  misc_feature (341)..(341): Xaa can be any naturally occurring amino acid
  misc_feature (378)..(378): Xaa can be any naturally occurring amino acid
  misc_feature (383)..(383): Xaa can be any naturally occurring amino acid
  misc_feature (394)..(394): Xaa can be any naturally occurring amino acid
  misc_feature (431)..(431): Xaa can be any naturally occurring amino acid
  misc_feature (443)..(443): Xaa can be any naturally occurring amino acid
  misc_feature (448)..(448): Xaa can be any naturally occurring amino acid
MAAAVSTVGAXXXXPXXLXXSXXXXXXXXXSXFLGXXLKKXXXXXXXXXXXXSXXXSXXVXAXXXXXEIDEXKQTDXDRWKGLAYXXDISDDQQDITRGKGMVDSLFQAPXGXXGTHXAVLSSYEYISQGLRXYXXXXDNXMDGFYIAPAFMDKLVVHITKNFMTLPNIKVPLILGIWGGKGQGKSFQCELVFAKMGINPIMMSAGELESGNAGEPAKLIRQRYREAADIIKKXGKMCCLFINDLDAGAGRMGGTTQYTVNNQMVNATLMNIADNPTNVQLPGMYNKEENPRVPIIVTGNDFSTLYAPLIRDGRMEKFYWAPTREDRIGVCKGIFRTDNVXDEDIVKLVDTFPGQSIDFFGALRARVYDDEVRKWVSXVGVEXIGKRLVNSREXGPPTFEQPKMTIEKLLEYGNMLVQEQENVKRVQLADXYLSEAALGDANXDAIKXGSFYG

The invention claimed is:

1. A method for enhancing a seed yield-related trait in a plant relative to a control plant, comprising
   (a) increasing expression in a plant of an isolated nucleic acid, and
   (b) selecting for a plant having an enhanced seed yield-related trait relative to a corresponding control plant,
   wherein the isolated nucleic acid comprises a nucleic acid sequence encoding a Circadian Clock Associated1 (CCA1)-like protein, which comprises a SANT domain having motif 1 of SEQ ID NO: 141 and motif 2 of SEQ ID NO: 142, where the nucleic acid sequence comprises
   i) the nucleic acid sequence of SEQ ID NO: 1;
   ii) a nucleic acid sequence encoding a polypeptide comprising the amino acid sequence of SEQ ID NO: 2;
   iii) a nucleic acid sequence encoding a polypeptide comprising an amino acid sequence having at least 90% sequence identity to SEQ ID NO: 2; or
   iv) a nucleic acid sequence capable of hybridizing with the nucleic acid sequence of SEQ ID NO: 1 under stringent hybridization conditions which comprise hybridization at 65° C. in 1×SSC or at 42° C. in 1×SSC and 50% formamide followed by washing at 50° C. in 2×SSC 65° C. in 0.3×SSC; and
   wherein said increased expression is effected by introducing and expressing in a plant, plant cell, or plant part said isolated nucleic acid, and
   wherein said seed yield-related trait comprises any one or more of the following: total seed yield, number of filled seeds, seed fill rate, number of flowers per panicle, harvest index, or thousand kernel weight.

2. The method of claim 1, wherein said CCA1-like protein sequence further comprises motif 3 of SEQ ID NO: 143.

3. The method of claim 1, wherein said nucleic acid is operably linked to a constitutive promoter.

4. The method of claim 1, wherein the constitutive promoter comprises a GOS2 promoter.

5. The method of claim 1, wherein said nucleic acid is of plant origin.

6. The method of claim 5, wherein said nucleic acid is from a dicotyledonous plant.

7. The method of claim 6, wherein said nucleic acid is from the family Brassicaceae.

8. The method of claim 7, wherein said nucleic acid is from the genus *Arabidopsis*.

9. The method of claim 7, wherein said nucleic acid is from *Arabidopsis thaliana*.

10. A method for the production of a transgenic plant having an enhanced seed yield-related trait relative to a corresponding control plant, comprising:
    (1) introducing and expressing in a plant, of plant cell, or plant part an isolated nucleic acid, wherein the isolated nucleic acid comprises a nucleic acid encoding a CCA1-like protein comprising a SANT domain having motif 1 of SEQ ID NO: 141 and motif 2 OF of SEQ ID NO: 142; where the nucleic acid sequence comprises
        i) the nucleic acid sequence of SEQ ID NO: 1;
        ii) a nucleic acid sequence encoding a polypeptide comprising the amino acid sequence of SEQ ID NO: 2;
        iii) a nucleic acid sequence encoding a polypeptide comprising an amino acid sequence having at least 90% sequence identity to SEQ ID NO: 2; or
        iv) a nucleic acid sequence capable of hybridizing with the nucleic acid sequence of SEQ ID NO: 1 under stringent hybridization conditions which comprise hybridization at 65° C. in 1×SSC or at 42° C. in 1×SSC and 50% formamide followed by one or more washes at 65° C. in 0.3×SSC;
    (2) cultivating the plant cell or plant or part thereof under conditions promoting plant growth and development; and
    (3) selecting for a plant having an enhanced seed yield-related trait relative to a corresponding control plant,
    wherein said seed yield-related trait comprises any one or more of the following: total seed yield, number of filled seeds, seed fill rate, number of flowers per panicle, harvest index, or thousand kernel weight.

11. The method of claim 1, wherein the enhanced seed yield-related trait is increased seed yield relative to a control plant.

12. The method of claim 1, wherein said CCA1-like protein sequence further comprises motif 4 of SEQ ID NO: 144.

13. The method of claim 1, wherein said CCA1-like protein sequence further comprises motif 5 of SEQ ID NO: 145.

* * * * *

UNITED STATES PATENT AND TRADEMARK OFFICE
CERTIFICATE OF CORRECTION

PATENT NO.         : 8,569,575 B2  
APPLICATION NO.    : 12/519787  
DATED              : October 29, 2013  
INVENTOR(S)        : Ana Isabel Sanz Molinero Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 557 days.

Signed and Sealed this
Twenty-second Day of September, 2015

Michelle K. Lee
*Director of the United States Patent and Trademark Office*